US011041218B2

(12) United States Patent
Jauert et al.

(10) Patent No.: US 11,041,218 B2
(45) Date of Patent: Jun. 22, 2021

(54) GENETICALLY MODIFIED TREHALASE-EXPRESSING YEASTS AND FERMENTATION PROCESSES USING SUCH GENETICALLY MODIFIED YEASTS

(71) Applicant: CARGILL, INCORPORATED, Wayzata, MN (US)

(72) Inventors: Peter Alan Jauert, Minneapolis, MN (US); Gregory Michael Poynter, Saint Paul, MN (US); Brian J. Rush, Minneapolis, MN (US)

(73) Assignee: CARGILL, INCORPORATED, Wayzata, MN (US)

(*) Notice: Subject to any disclaimer, the term of this patent is extended or adjusted under 35 U.S.C. 154(b) by 0 days.

(21) Appl. No.: 16/609,548

(22) PCT Filed: May 4, 2018

(86) PCT No.: PCT/US2018/031110
§ 371 (c)(1),
(2) Date: Oct. 30, 2019

(87) PCT Pub. No.: WO2018/204798
PCT Pub. Date: Nov. 8, 2018

(65) Prior Publication Data
US 2020/0063221 A1    Feb. 27, 2020

Related U.S. Application Data

(60) Provisional application No. 62/501,288, filed on May 4, 2017, provisional application No. 62/636,716, filed on Feb. 28, 2018, provisional application No. 62/648,679, filed on Mar. 27, 2018.

(51) Int. Cl.
*C12P 7/06* (2006.01)
*C12R 1/865* (2006.01)
*C12N 9/26* (2006.01)

(52) U.S. Cl.
CPC ............ *C12R 1/865* (2013.01); *C12N 9/2408* (2013.01); *C12P 7/06* (2013.01); *C12Y 302/01003* (2013.01); *C12Y 302/01028* (2013.01)

(58) Field of Classification Search
CPC ...................................................... C12P 7/06
See application file for complete search history.

(56) References Cited

U.S. PATENT DOCUMENTS 6,551,829 B1    4/2003  Takano et al.

FOREIGN PATENT DOCUMENTS

| WO | 2015065978 A1 | 5/2015 |
| WO | 2016127083 A1 | 8/2016 |
| WO | 2016160584 A1 | 10/2016 |
| WO | 2016205127 A1 | 12/2016 |
| WO | 2017077504 A1 | 5/2017 |
| WO | 2017106739 A1 | 6/2017 |
| WO | 2018027131 A1 | 2/2018 |
| WO | 2018053230 A1 | 3/2018 |

OTHER PUBLICATIONS

Foster, Andrew J., et al., "Trehalose synthesis and metabolism are required at different stages of plant infection by Megnaporthe grisea", The EMBO Journal vol. 22 No. 2 pp. 225-235, 2003.
Parrou, Jean Luc, et al., "Acid trehalase in yeasts and filamentous fungi: Localization, regulation and physiological function", FEMS Yeast Research 5 (2005) 503-511.
He, et al. "The *Saccharomyces cerevisiae* vacuolar acid trehalase is targeted at the cell surface for its physiological function" (2009) FEBS Journal, 276 (19), pp. 5432-5446.
Mugabo et al. "Identification of a mammalian glycerol-3-phosphate phosphatase: Role in metabolism and signaling in pancreatic β-cells and hepatocytes" PNAS (2016) 113:E430-439.
Norbeck et al. "Purification and Characterization of Two Isoenzymes of DL-Glycerol-3-phosphatase from *Saccharomyces cerevisiae*" (1996) J. Biol. Chem. 10 271(23):13875-81.
Pahlman et al. "The Yeast Glycerol 3-Phosphatases Gpp1p and Gpp2p Are Required for Glycerol Biosynthesis and Differentially Involved in the Cellular Responses to Osmotic, Anaerobic, and Oxidative Stress" (2001) J. Biol. Chem. 276(5):3555-63.
Rosenberg et al. "The preparation and properties of a new glyceraldehyde-3-phosphate dehydrogenase from photosynthetic tissues," J. Biol. Chem. (1955) 217:361-71.
Trevisol, et al. "The effect of trehalose on the fermentation performance of aged cells of *Saccharomyces cerevisiae*" (2011) Applied Microbiology and Biotechnology, 90 (2), pp. 697-704.
Uniprot No. P40106; Feb. 1, 1995.
Uniprot No. P41277; dated Jan. 23, 2007.
Uniprot No. P41911; dated Oct. 1, 1996.
Uniprot No. Q00055; dated Jan. 23, 2007.
Uniprot No. Q2HQS1; dated Mar. 21, 2006.
Amaral F C et al: "Molecular cloning of the neutral trehalase gene from Kluyveromyces lactis and the distinction between neutral and acid trehalases", Archives of Microbiology, Springer Berlin Heidelberg, Berlin/Heidelberg, vol. 167, No. 4, Mar. 4, 1997 (Mar. 4, 1997), pp. 202-208, XP035866404, ISSN: 0302-8933, DOI: 10.1007/S002030050436.
Database UNIPROT: [Online] UNIPROT; Aug. 16, 2004 (Aug. 16, 2004), Dujon B et al: "Glycoside Hydrolase Family 65 from Kluyveromyces lactis (strain ATCC 8585) (Yeast) (Candida sphaerica)", XP055779320,accession No. UNIPROT:Q6CP92 KLULA, Database accession No. Q6CP92_KLULA.
Liu et al: "Expression, purification, and characterization of recombinant Metarhizium anisopliae acid trehalase in Pichia pastoris", Protein Expression and Purification, Academic Press, San Diego, CA, vol. 54, No. 1, Apr. 26, 2007 (Apr. 26, 2007) , pp. 66-72, XP022056636, ISSN: 1046-5928, DOI: 10.1016/J.PEP.2007.02.016.

*Primary Examiner* — Tekchand Saidha

(57) ABSTRACT

The present invention relates to genetically engineered yeasts having a heterologous trehalase gene and fermentation processes for using such yeasts. The yeasts can express trehalase in a quantity sufficient to convert significant amounts of trehalose to glucose, thereby improving the yield of the product in a fermentation, and/or reducing or eliminating the need to add exogenous trehalase to the fermentation. The yeasts can also include other heterologous genes for expressing enzymes useful for improving yield and/or for reducing or eliminating the need to add exogenous enzymes to the fermentation.

20 Claims, 11 Drawing Sheets

Specification includes a Sequence Listing.

GENETICALLY MODIFIED TREHALASE-EXPRESSING YEASTS AND FERMENTATION PROCESSES USING SUCH GENETICALLY MODIFIED YEASTS

CROSS-REFERENCE TO RELATED APPLICATIONS

This application is a national phase application of International Application No. PCT/US2018/031110, filed May 4, 2018, which claims the benefit of U.S. Provisional Patent Application No. 62/501,288, filed May 4, 2017; U.S. Provisional Patent Application No. 62/636,716, filed Feb. 28, 2018; and U.S. Provisional Patent Application No. 62/648,679, filed Mar. 27, 2018, all of which are hereby incorporated by reference in their entirety.

SEQUENCE LISTING

The entire contents of the ASCII text file entitled "N00525_ST25.txt," created on 4 May 2018, and having a size of 761 kilobytes is hereby incorporated herein by reference.

BACKGROUND OF THE INVENTION

Trehalose is a disaccharide produced in microorganisms, including *Saccharomyces cerevisiae*. Trehalose is often produced as a result of stress on the organism. Trehalase is a glycoside hydrolase enzyme that catalyzes the conversion of trehalose to glucose. Some microorganisms can natively produce a neutral pH trehalase and/or an acid trehalase. However, wild type yeasts do not produce significant quantities of trehalase.

SUMMARY OF THE INVENTION

The present invention relates to a genetically engineered yeast that can express a heterologous trehalase. The trehalase expressed by the yeast increases ethanol output from fermentation by converting trehalose produced by the yeast, or trehalose that is otherwise present in the fermentation broth, into glucose.

In one aspect, this disclosure relates to a genetically modified yeast comprising a heterologous gene encoding a trehalase (EC 3.2.1.28), wherein the yeast is capable of producing ethanol when the yeast is present in a fermentation medium comprising trehalose. In some embodiments, the trehalase is an acid trehalase. In some embodiments, the trehalase is a neutral trehalase. In some embodiments, the yeast encodes both an acid trehalase and a neutral trehalase. In some embodiments, the gene encoding the trehalase is from *Kluyveromyces lactis*. In some embodiments, the gene encoding the trehalase is from *Candida parapsilosis*. In some embodiments, the gene encoding the trehalase is from *Candida glabrata*. In some embodiments, the gene encoding the trehalase is from *Magnaporthe grisea*. In some embodiments, the trehalase polypeptide encoded by the yeast has a sequence identity of at least 75, 80, 85, 90, 95, or 97% to at least one of the following polypeptide sequences: SEQ ID NO: 1, SEQ ID NO: 2, SEQ ID NO: 3, or SEQ ID NO: 87. In some embodiments, the trehalase polypeptide encoded by the yeast includes a sequence that has a sequence identity of at least 70, 80, 90, or 95% to SEQ ID NO: 83. In some embodiments, the trehalase polypeptide encoded by the yeast includes a sequence that has a sequence identity of at least 70%, at least 75%, at least 80%, at least 85%, at least 90%, at least 94%, or 100% sequence identity to SEQ ID NO: 84 and/or SEQ ID NO: 85. In some embodiments, the yeast is a genetically modified *S. cerevisiase*. In some embodiments, the trehalase polypeptide encoded by the yeast has a sequence identity of at least 75, 80, 85, 90, 95, or 97% to at least one of the following polypeptide sequences: SEQ ID NO: 88, SEQ ID NO: 89, SEQ ID NO: 90, or SEQ ID NO: 91.

In some embodiments, the yeast comprises a signal sequence for the heterologous trehalase that is not native to the species that the trehalase is derived from. In some embodiments, the heterologous trehalase comprises a non-native signal sequence. In some embodiments, the heterologous trehalase comprises its native signal sequence. In some embodiments, the signal sequence is a MFα2 signal sequence. In some embodiments, the MFα2 signal sequence is SEQ ID NO: 4. In some embodiments, the MFα2 signal sequence has a sequence identity of at least 84%, 89%, or 94% to SEQ ID NO: 4. In some embodiments, the trehalase polypeptide encoded by the yeast has a sequence identity of at least 75, 80, 85, 90, 95, or 97% to at least one of the following polypeptide sequences: SEQ ID NO: 8, SEQ ID NO: 11, SEQ ID NO: 14, or SEQ ID NO: 92.

In one aspect, the yeast includes at least one heterologous gene encoding a polypeptide other than a trehalase. In some embodiments, the yeast comprises a heterologous gene encoding a glucoamylase (EC 3.2.1.3). In some embodiments, the heterologous gene encoding a glucoamylase is a glucoamylase gene is from a species selected from the group consisting of *Amorphotheca resinae, Aspergillus niger, Aspergillus awamori, Aspergillus oryzae, Aspergillus kawachii, Aspergillus shirousami, Blastobotrys adeninivorans, Candida albicans, Rhizopus oryzae, Schizosaccharomyces pombe, Saccharomycopsis fibuligera, Brettanomyces bruxellensis*, and *Cyberlindnera jadinii*. In some embodiments, the glucoamylase encoded by the yeast has a sequence identity of at least 70, 80, 90, or 95% to at least one of the following polypeptide sequences: SEQ ID NO: 16, SEQ ID NO: 17, SEQ ID NO: 18, or SEQ ID NO: 19. In some embodiments, the yeast comprises a heterologous gene encoding an isomaltase (EC 3.2.1.10). In some embodiments, the yeast comprises a heterologous gene for a sugar transporter with a sequence identity of at least 70, 80, 90, or 95% to the polypeptide of SEQ ID NO: 20. In some embodiments, the yeast comprises a heterologous gene for a sugar transporter with a sequence identity of at least 70, 80, 90, or 95% to the polypeptide of SEQ ID NO: 21.

In one aspect, the yeast includes features related to lactate consumption. In some embodiments, the yeast comprises a heterologous gene encoding a cytochrome b2 (CYB2) (EC 1.1.2.3) polypeptide. In some embodiments, the CYB2 polypeptide has an amino acid sequence with a sequence identity of at least 50%, 55%, 65%, 70%, 75%, 80%, 85%, 90%, 95%, 97%, or 99% to any one of the following amino acid sequences: SEQ ID NO: 27, SEQ ID NO: 28, SEQ ID NO: 29, SEQ ID NO: 30, SEQ ID NO: 31, SEQ ID NO: 32, or SEQ ID NO: 33. In some embodiments, the yeast encodes a CYB2 polypeptide comprising one or more of the following residues at the indicated positions in SEQ ID NO: 27, SEQ ID NO: 28, SEQ ID NO: 29, SEQ ID NO: 30, SEQ ID NO: 31, SEQ ID NO: 32, or SEQ ID NO: 33: Lys349, Tyr143, Tyr254, and His373. In some embodiments, the yeast comprises a heterologous gene encoding a D-lactate dehydrogenase (DLD) (EC 1.1.2.4) polypeptide. In some embodiments, the DLD polypeptide has an amino acid sequence with a sequence identity of at least 50%, 55%, 65%, 70%, 75%, 80%, 85%, 90%, 95%, 97%, or 99% to any one of the following amino acid sequences: SEQ ID NO: 34, SEQ ID NO: 35, SEQ ID NO: 36, SEQ ID NO: 37, SEQ ID NO: 38, SEQ ID NO: 39, SEQ ID NO: 40, or SEQ ID NO: 41. In some embodiments, the yeast comprises a heterologous gene encoding a monocarboxylic/monocarboxylate transporter. In some embodiments, the monocarboxylic/monocarboxylate transporter encoded by the yeast has an amino acid sequence with a sequence identity of at least 50%, 55%, 65%, 70%, 75%, 80%, 85%, 90%, 95%, 97%, or 99% to any one of the following amino acid sequence: SEQ ID NO: 22, SEQ ID NO: 23, SEQ ID NO: 24, SEQ ID NO: 25, or SEQ ID NO: 26.

In some embodiments, the yeast secretes trehalase in an amount sufficient to reduce the trehalose content of a fermentation broth to less than 0.5 g/L, 1 g/L, 2 g/L, 3 g/L, 4 g/L, 5 g/L, 6 g/L, 7 g/L, 8 g/L, 9 g/L, or 10 g/L when the ethanol titer is at least 75 g/L. In some embodiments, the yeast is capable of secreting the trehalase extracellularly. In some embodiments, the trehalase polypeptide encoded by the yeast has a sequence identity of at least 76%, at least 84%, at least 92%, or 100% sequence identity to SEQ ID NO: 86. In some embodiments, the yeast is capable of producing ethanol at a titer of 80 g/L, 90 g/L, 100 g/L, 110 g/L, 120 g/L, 125 g/L, 130 g/L, 135 g/L or greater.

In one aspect, the disclosure relates to processes using any of the yeasts described herein. In one embodiment, the process is a process for manufacturing ethanol comprising: fermenting a medium using a genetically modified yeast, wherein the yeast comprises a heterologous trehalase gene, wherein the ethanol titer at the end of fermentation is at least 90 g/L. In some embodiments, the fermentation temperature of the process is in the range of 25 to 45° C., 25 to 40° C., 25 to 35° C., 30 to 40° C., or 28 to 38° C. In some embodiments, the ethanol titer at the end of fermentation is at least 80, 90, 100, 110, 120, 130, 135, 140, 145, 150, 155, or 160 g/liter.

In one aspect, the disclosure relates to a genetically modified yeast comprising a heterologous gene encoding a trehalase (EC 3.2.1.28) polypeptide having a sequence identity of at least 80% to SEQ ID NO: 1 (*K. lactis*) wherein the yeast is capable of producing ethanol when the yeast is present in a fermentation medium comprising trehalose and the yeast secretes trehalase in an amount sufficient to reduce the trehalose content of a fermentation broth to less than 2 g/L when the ethanol titer is at least 110 g/L. In one aspect, the disclosure relates to a genetically modified yeast comprising a heterologous gene encoding a trehalase (EC 3.2.1.28) polypeptide having a sequence identity of at least 80% to SEQ ID NO: 2 (*C. parapsilosis*) wherein the yeast is capable of producing ethanol when the yeast is present in a fermentation medium comprising trehalose and the yeast secretes trehalase in an amount sufficient to reduce the trehalose content of a fermentation broth to less than 2 g/L when the ethanol titer is at least 110 g/L. In one aspect, the disclosure relates to a genetically modified yeast comprising a heterologous gene encoding a trehalase (EC 3.2.1.28) polypeptide having a sequence identity of at least 80% to SEQ ID NO: 3 (*C. glabrata*) wherein the yeast is capable of producing ethanol when the yeast is present in a fermentation medium comprising trehalose and the yeast secretes trehalase in an amount sufficient to reduce the trehalose content of a fermentation broth to less than 2 g/L when the ethanol titer is at least 110 g/L. In one aspect, the disclosure relates to a genetically modified yeast comprising a heterologous gene encoding a trehalase (EC 3.2.1.28) polypeptide having a sequence identity of at least 80% to SEQ ID NO: 87 (*M. grisea*) wherein the yeast is capable of producing ethanol when the yeast is present in a fermentation medium comprising trehalose and the yeast secretes trehalase in an amount sufficient to reduce the trehalose content of a fermentation broth to less than 2 g/L when the ethanol titer is at least 110 g/L In some embodiments, the trehalase polypeptide encoded by the yeast comprises a sequence that has a sequence identity of at least 70, 80, 90, or 95% to SEQ ID NO: 83. In some embodiments, the trehalase polypeptide encoded by the yeast comprises a sequence that has a sequence identity of at least 70%, at least 75%, at least 80%, at least 85%, at least 90%, at least 94%, or 100% sequence identity to SEQ ID NO: 84 and/or SEQ ID NO: 85. In some embodiments, the yeast is a genetically modified *S. cerevisiae*. In some embodiments, the trehalase encoded by the yeast comprises a MFα2 signal sequence. In some embodiments, the MFα2 signal sequence is SEQ ID NO: 4. In some embodiments, the MFα2 signal sequence has a sequence identity of at least 84%, 89%, or 94% to SEQ ID NO: 4. In some embodiments, the trehalase encoded by the yeast has a sequence identity of at least 75, 80, 85, 90, 95, or 97% to at least one of the following polypeptide sequences: SEQ ID NO: 8, SEQ ID NO: 11, SEQ ID NO: 14, or SEQ ID NO: 92.

In one aspect, the yeast further comprises a heterologous gene encoding a glucoamylase (EC 3.2.1.3) polypeptide. In some embodiments, the glucoamylase polypeptide encoded by the yeast has a sequence identity of at least 70, 75, 80, 85, 90, or 95% to at least one of the following polypeptide sequences: SEQ ID NO: 16 (Sf GA), SEQ ID NO: 17 (Ro GA), SEQ ID NO: 108 (Rmic GA), or SEQ ID NO: 109 (Rdel GA).

In one aspect, the yeast secretes trehalase in an amount sufficient to reduce the trehalose content of a fermentation broth to less than 0.5 g/L or 1 g/L when the ethanol titer is at least 110 g/L. In some embodiments, the yeast is capable of secreting the trehalase extracellularly. In some embodiments, the trehalase polypeptide encoded by the yeast comprises a sequence that has a sequence identity of at least 76%, at least 84%, at least 92%, or 100% sequence identity to SEQ ID NO: 86.

In one aspect, the yeast comprises a recombinant nucleic acid encoding a glyceraldehyde-3-phosphate dehydrogenase (E.C. 1.2.1.9); and reduced or eliminated expression of a gene encoding a glycerol-3-phosphate phosphatase (E.C. 3.1.3.21). In one aspect, the yeast comprises a recombinant nucleic acid encoding a glyceraldehyde-3-phosphate dehydrogenase (GAPN, E.C. 1.2.1.9). In some embodiments, the recombinant nucleic acid encoding a glyceraldehyde-3-phosphate dehydrogenase (E.C. 1.2.1.9) encodes for a polypeptide having a sequence identify of at least 80%, 85%, 90%, or 95% to SEQ ID NO: 111 (*Bacillus cereus* GAPN).

In some embodiments, the yeast is capable of producing ethanol at a titer of 80 g/L, 90 g/L, 100 g/L, 110 g/L, 120 g/L, 125 g/L, 130 g/L, 135 g/L or greater. In some embodiments, the yeast produces a higher titer and/or yield of ethanol compared to a yeast that does not express a heterologous trehalase. In some embodiments, the yeast produces a higher titer and/or yield of ethanol compared to a yeast that does not express a heterologous trehalase, but is otherwise identical to the yeast. In some embodiments, the yeast produces a higher titer and/or yield of ethanol compared to a yeast that expresses a different heterologous trehalase.

In one aspect, the disclosure relates to a process for manufacturing ethanol comprising: fermenting a medium using a genetically modified yeast, wherein the yeast comprises a heterologous trehalase gene encoding a trehalase (EC 3.2.1.28) polypeptide having a sequence identity of at least 80% to one or more of the following polypeptide sequences: SEQ ID NO: 1 (*K. lactis*), SEQ ID NO: 2 (*C. parapsilosis*), SEQ ID NO: 3 (*C. glabrata*), or SEQ ID NO: 87 (*M. grisea*), wherein the ethanol titer at the end of fermentation is at least 105 g/L as measured 36 h after inoculation and the trehalose content of the fermentation broth at the end of fermentation is less than 2 g/L. In some embodiments, the yeast of the process comprises a heterologous trehalase gene encoding a trehalase (EC 3.2.1.28) polypeptide having a sequence identity of at least 80% to only one of the following polypeptide sequences: SEQ ID NO: 1 (*K. lactis*), SEQ ID NO: 2 (*C. parapsilosis*), SEQ ID NO: 3 (*C. glabrata*), or SEQ ID NO: 87 (*M. grisea*). It is to be understood that the yeast used in the process for manufacturing ethanol can be any embodiment of the yeast described herein, including any trait or modification described in combination with any other trait(s) or modification(s) described.

In some embodiments, the fermentation temperature is in the range of 25 to 45° C., 25 to 40° C., 25 to 35° C., 30 to 40° C., or 28 to 38° C. In some embodiments, the ethanol titer at the end of fermentation is at least 120, 130, 135, 140, 145, 150, 155, or 160 g/liter. In some embodiments, the yeast is the yeast of any embodiment or aspect described herein.

Values for ethanol and trehalose content in a fermentation broth can be evaluated and measured according to the Shake Flask Method described below in Example 1.

It is also to be understood that the elements or aspects of any embodiment of the processes, methods, or compositions described above can be applied to any other embodiment, as would be understood by a person skilled in the art.

BRIEF DESCRIPTION OF THE DRAWINGS

The following detailed description of the invention will be better understood when read in conjunction with the appended drawings. It should be understood, however, that the invention is not limited to the precise arrangements and instrumentalities of the embodiments shown in the drawings.

DETAILED DESCRIPTION

Figure 1:
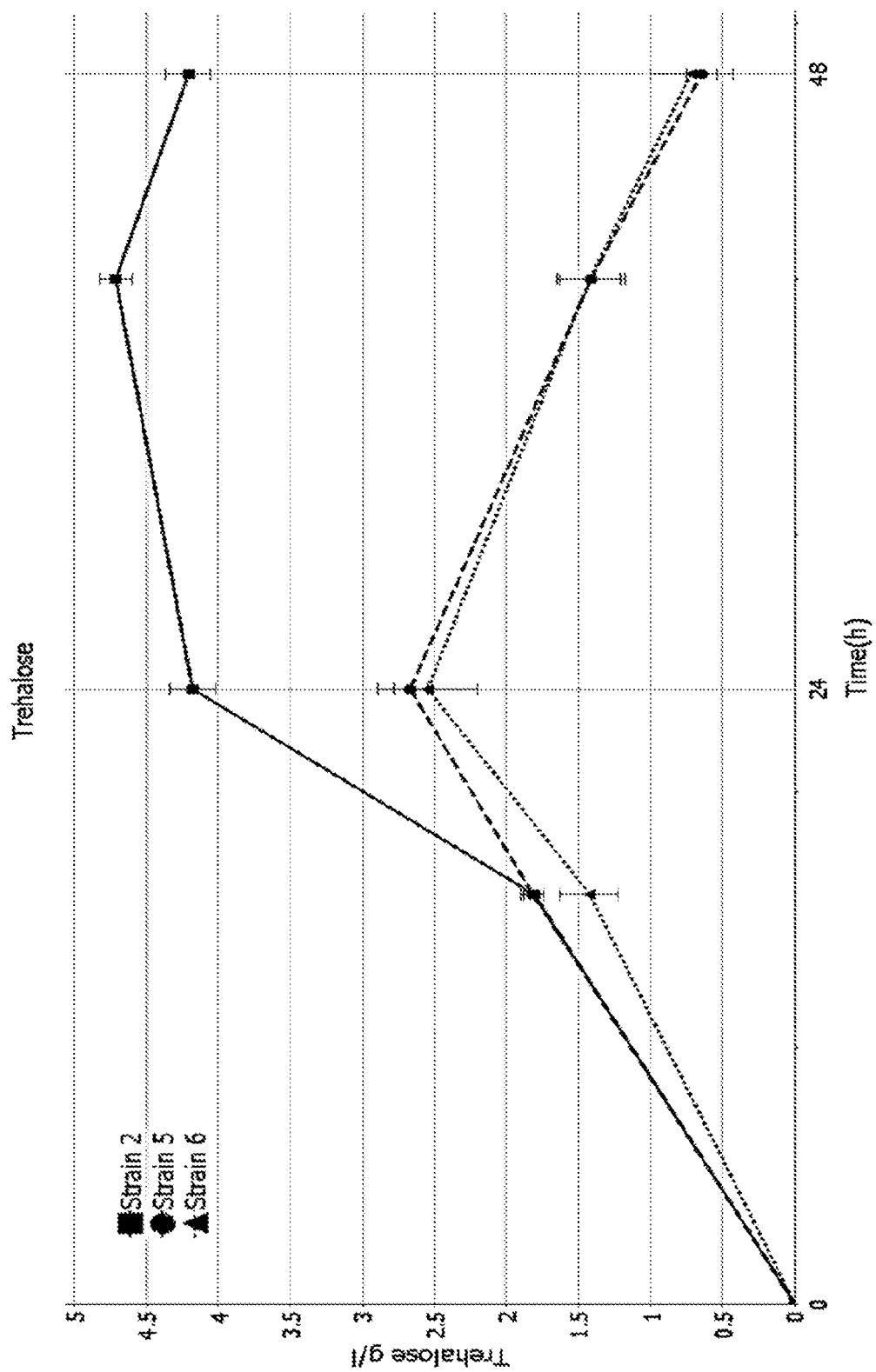
FIG. 1 is a graph showing trehalose concentration over time in a fermentation using different yeast trains.

It is to be understood that the figures and descriptions of the present invention provided herein have been simplified to illustrate elements that are relevant for a clear understanding of the present invention, while eliminating other elements found in the related field(s) of art. Those of ordinary skill in the art would recognize that other elements or steps may be desirable or required in implementing the present invention. However, because such elements or steps are well known in the art or do not facilitate a better understanding of the present invention, a discussion of such elements or steps is not provided herein.

Definitions

Unless defined otherwise, all technical and scientific terms used herein have the same meaning as commonly understood by one skilled in the art to which this invention belongs. As used herein, each of the following terms has the meaning associated with it as defined in this section.

Fermentation Process Definitions

As used herein, "inoculation" is defined as the point in time wherein a microorganism capable of producing a fermentation product is introduced into a fermentation medium. This is a term that is well known to those skilled in the art.

As used herein, "end of fermentation" is defined as the point in time where a fermentation process meets a predetermined criteria. The predetermined criteria can include any of the following: a predetermined time interval, exhaustion of the desired fraction of carbon source supplied, cessation of carbon source consumption, or cessation of fermentation product formation. In one embodiment, "end of fermentation" is defined as the point in time where harvesting of the bioproduct is started. As would be understood by a person skilled in the art, "end of fermentation" can refer to a point in time that is different depending on the scale and purpose of the fermentation process. For a large-scale production fermentation process, the "end of fermentation" is preferably the point at which harvesting of the bioproduct is started, i.e., after product formation has effectively stopped.

As used herein, "cell dry weight" refers to the concentration of dry cell mass present in a fermentation medium at the time of measurement, as measured in a fermentation sample. Cell dry weight is commonly expressed in units of grams/liter (g/L).

As used herein, "cell dry weight at inoculation" refers to the concentration of dry cell mass present in a fermentation medium immediately following inoculation, as measured in a fermentation sample. For fed-batch fermentations, the initial cell dry weight is calculated based on the final volume of fermentation medium. Measurement of dry cell weight is a method known to those skilled in the art. Cell dry weight at inoculation is commonly expressed in units of g/L.

As used herein, "cell dry weight at end of fermentation" refers to the concentration of dry cell mass present in a fermentation medium at the end of fermentation, as measured in a fermentation sample. Cell dry weight at end of fermentation is commonly expressed in units of g/L.

As used herein, "final titer" refers to the concentration of a substance in the fermentation broth at the end of fermentation. The final titer is commonly expressed in units of g/L.

As used herein, "initial titer" refers to the concentration of a substance present at inoculation. The initial titer is commonly expressed in units of g/L.

As used herein, "batch time" refers to the amount of time that has elapsed between the inoculation and the end of fermentation. The batch time is commonly expressed in units of hours (h).

As used herein, "fermentation production rate" for a batch process refers to the final titer minus initial titer of fermentation product (final titer minus initial titer) divided by the batch time. The production rate is commonly expressed in units of grams per liter-hour (g $L^{-1}$ $h^{-1}$). When applied to a continuous or semi-continuous process, the "fermentation production rate" is determined using methods known in the art.

As used herein, the "specific production rate" refers to the fermentation production rate divided by the cell dry weight at the end of fermentation. The specific production rate is commonly expressed in units of (g product) (g cells)$^{-1}$ $h^{-1}$. When applied to a continuous or semi-continuous process, the "specific production rate" is determined using methods known in the art.

As used herein, "product yield" of a fermentation product refers to a ratio of two quantities: a) mass of product (e.g., succinate) produced in the course of the fermentation (numerator) b) the mass of carbon source added to the fermentation (denominator). The product yield as a percentage is commonly expressed in units of gram per gram (g/g) times 100. Particular note should be taken that product yield is calculated as a ratio of masses. The mass of fermentation product produced should account for the mass of fermentation product present in the fermentation medium at the end of the batch, as well as the mass of any fermentation product harvested during the course of the batch, less the mass of fermentation product present at the start of batch, and further less the mass of any fermentation product added during the course of the batch. The mass of carbon source added to the batch should include the mass of all carbon source(s) present in the fermenter at the start of the batch in addition to the mass of any carbon source(s) added during the course of the batch.

As used herein, "oxygen uptake rate" ("OUR") refers to the volumetric rate at which oxygen is consumed during a fermentation. Inlet and outlet oxygen concentrations can be measured with exhaust gas analysis, for instance by mass spectrometers. OUR can be calculated by one of ordinary skill in the relevant arts using the Direct Method described in Bioreaction Engineering Principles 2nd Edition, 2003, Kluwer Academic/Plenum Publishers, p. 449, equation 1. It is commonly measured in units of (mmol $O_2$) $L^{-1}$ $h^{-1}$.

As used herein, "specific oxygen uptake rate" refers to the specific rate at which oxygen is consumed during a fermentation. It is calculated as the ratio of the OUR to the measured cell dry weight. It is commonly measured in units of mmol $O_2$ (g cell dry weight)$^{-1}$ $h^{-1}$.

Yeast Characteristics Definitions

The terms "genetically modified" and "genetically engineered" are used interchangeably herein, and refer to any alteration of the genetic material of an organism, or to an organism that was so altered. For the purposes of this disclosure, these terms are not meant to be limited by the method of alteration.

In certain embodiments, the genetically modified yeast cells provided herein further comprise a deletion or disruption of one or more native genes. As used herein, the phrase "deletion or disruption" with regard to a native gene means that either the entire coding region of the gene is eliminated (deletion) or the coding region of the gene, its promoter, and/or its terminator region is modified (such as by deletion, insertion, or mutation) such that the gene no longer produces an active enzyme, produces a severely reduced quantity (at least 75% reduction, preferably at least 90% reduction) of an active enzyme, or produces an enzyme with severely reduced (at least 75% reduced, preferably at least 90% reduced) activity.

In certain embodiments, deletion or disruption of one or more native genes results in a deletion or disruption of one or more native metabolic pathways. The phrase "deletion or disruption" with regard to a metabolic pathway means that the pathway is either inoperative or else exhibits activity that is reduced by at least 75%, at least 85%, or at least 95% relative to the native pathway.

In some embodiments, deletion or disruption of native genes can be accomplished by forced evolution, mutagenesis, or genetic engineering methods, followed by appropriate selection or screening to identify the desired mutants. In some embodiments, deletion or disruption of a native host cell gene can be coupled to the incorporation of one or more exogenous genes into the host cell, i.e., the exogenous genes can be incorporated using a gene expression integration construct that is also a deletion construct. In some embodiments, deletion or disruption can be accomplished using a deletion construct that does not contain an exogenous gene or by other methods known in the art.

The term "heterologous" as used herein with regard to genetic components means that the genetic component is present in a modified version of a microorganism, but is not present in the genome of a native form of the particular microorganism cell. In some embodiments, the heterologous genetic component can be a modified form of a component that was native to the cell, it can be derived from another organism, it can be a modified form of a component derived from another organism, or it can be a synthetically-derived component. In a preferred embodiment, the heterologous genetic component is integrated into the genome of the modified microorganism. For example, the *K. lactis* trehalase gene is heterologous when introduced into *S. cerevisiae*.

The term "exogenous" as used herein means any material that originated outside the microorganism of interest. For example, the term "exogenous" can be applied to genetic material not present in the native form of a particular organism prior to genetic modification (i.e., such exogenous genetic material could also be referred to as heterologous), or it can also be applied to an enzyme or other protein that does not originate from a particular organism.

Inspection of nucleic acid or amino acid sequences for two nucleic acids or two polypeptides will reveal sequence identity and similarities between the compared sequences. Sequence alignment and generation of sequence identity include global alignments and local alignments which are carried out using computational approaches. An alignment can be performed using BLAST (National Center for Biological Information (NCBI) Basic Local Alignment Search Tool) version 2.2.31 software with default parameters Amino acid % sequence identity between amino acid sequences can be determined using standard protein BLAST with the following default parameters: Max target sequences: 100; Short queries: Automatically adjust parameters for short input sequences; Expect threshold: 10; Word size: 6; Max matches in a query range: 0; Matrix: BLOSUM62; Gap Costs: (Existence: 11, Extension: 1); Compositional adjustments: Conditional compositional score matrix adjustment; Filter: none selected; Mask: none selected. Nucleic acid % sequence identity between nucleic acid sequences can be determined using standard nucleotide BLAST with the following default parameters: Max target sequences: 100; Short queries: Automatically adjust parameters for short input sequences; Expect threshold: 10; Word size: 28; Max matches in a query range: 0; Match/Mismatch Scores: 1, −2; Gap costs: Linear; Filter: Low complexity regions; Mask: Mask for lookup table only. A sequence having an identity score of XX % (for example, 80%) with regard to a reference sequence using the NCBI BLAST version 2.2.31 algorithm with default parameters is considered to be at least XX % identical or, equivalently, have XX % sequence identity to the reference sequence.

Throughout this disclosure, various aspects of the invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 7 should be considered to have specifically disclosed subranges such as from 1 to 3, from 1 to 4, from 1 to 6, from 2 to 5, from 3 to 5, etc., as well as individual numbers within that range, for example, 1, 2, 3, 3.6, 4, 5, 5.8, 6, 7, and any whole and partial increments in between. This applies regardless of the breadth of the range.

Description

Described herein are genetically modified yeast strains useful for manufacturing a fermentation product and fermentation processes using these yeasts. The yeast strains are modified to include one or more heterologous trehalase genes. In some embodiments, the yeast strains can also include other heterologous genes, for example a heterologous glucoamylase gene, without having any significant adverse effects on the desired level of heterologous enzyme expression and/or yeast performance in fermentation processes.

Genetically Engineered Yeast

Trehalase is a glycoside hydrolase enzyme that catalyzes the conversion of trehalose to glucose. In one aspect, the genetically engineered (GE) yeast described herein has been modified to include a heterologous trehalase gene. In some embodiments, the GE yeast is produced from a *S. cerevisiae* host yeast cell. In some embodiments, the host yeast cell is a yeast strain that is suitable for ethanol production, for example Ethanol Red™ or a similar strain of *S. cerevisiae*. Accordingly, in some embodiments, the GE yeast is tolerant to the conditions used in an ethanol fermentation process, such as relatively high temperatures and/or ethanol concentrations. In some embodiments, the inclusion of a heterologous trehalase gene can improve heat and/or ethanol tolerance compared to the host cell.

In some embodiments, the GE yeast can include one or more genes for expressing a trehalase polypeptide from one or more of the following species: *Kluyveromyces lactis, Candida parapsilosis,* and *Candida glabrata*. In some embodiments, the GE yeast expresses a trehalase polypeptide with a sequence identity of at least 70%, 75%, 80%, 85%, 90%, 95%, or 97% to at least one of the following amino acid sequences: SEQ ID NO: 1 (*Kluyveromyces lactis*), SEQ ID NO: 2 (*Candida parapsilosis*), or SEQ ID NO: 3 (*Candida glabrata*). In some embodiments, the GE yeast expresses a trehalase polypeptide from *Magnaporthe grisea* (SEQ ID NO: 87). In some embodiments, the GE yeast expresses a trehalase polypeptide with a sequence identity of at least 70%, 75%, 80%, 85%, 90%, 95%, or 97% to SEQ ID NO: 87. In one aspect, the GE yeast can include an overexpressed native trehalase gene instead of or in addition to a heterologous trehalase gene, for example an overexpressed *S. cerevisiae* trehalase gene in a GE yeast derived from a *S. cerevisiae* host yeast. For the purposes of this disclosure and the claims, any overexpressed native gene and any polypeptide encoded from such a gene will be considered heterologous.

In some embodiments, the GE yeast can include one or more genes for expressing a trehalase polypeptide from one or more of the following species, wherein the associated polypeptide sequence for each species is included in parentheses next to the species name: *Saccharomyces cerevisiae* (SEQ ID NO: 42), *Torulaspora delbrueckii* (SEQ ID NO: 43), *Kazachstania naganishii* (SEQ ID NO: 44), *Tetrapisispora blattae* (SEQ ID NO: 45), *Zygosaccharomyces rouxii* (SEQ ID NO: 46), *Zygosaccharomyces parabailii* (SEQ ID NO: 47), *Tetrapisispora phaffii* (SEQ ID NO: 48), *Eremothecium gossypii* (SEQ ID NO: 49), *Eremothecium sinecaudum* (SEQ ID NO: 50), *Lachancea mirantina* (SEQ ID NO: 51), *Candida orthopsilosis* (SEQ ID NO: 52), *Candida maltose* (SEQ ID NO: 53), *Candida tropicalis* (SEQ ID NO: 54), *Candida albicans* (SEQ ID NO: 55), *Lodderomyces elongisporus* (SEQ ID NO: 56), *Candida dubliniensis* (SEQ ID NO: 57), *Spathaspora passalidarum* (SEQ ID NO: 58), *Scheffersomyces stipitis* (SEQ ID NO: 59), *Debaryomyces fabryi* (SEQ ID NO: 60), *Candida tanzawaensis* (SEQ ID NO: 61), *Kluyveromyces dobzhanskii* (SEQ ID NO: 62), *Kluyveromyces marxianus* (SEQ ID NO: 63), *Zygosaccharomyces rouxii* (SEQ ID NO: 64), *Naumovozyma dairenensis* (SEQ ID NO: 65), *Lachancea thermotolerans* (SEQ ID NO: 66), *Lachancea quebecensis* (SEQ ID NO: 67), *Tetrapisispora phaffii* (SEQ ID NO: 68), *Lachancea fermentati* (SEQ ID NO: 69), *Lachancea nothofagi* (SEQ ID NO: 70), *Tetrapisispora blattae* (SEQ IDNO: 71), *Gaeumannomyces tritici* (SEQ ID NO: 72), *Magnaporthiopsis poae* (SEQ ID NO: 73), *Thermothelomyces thermophila* (SEQ ID NO: 74), *Colletotrichum nymphaeae* (SEQ ID NO: 75), *Colletotrichum orchidophilum* (SEQ ID NO: 76), *Coniochaeta ligniaria* (SEQ ID NO: 77), *Thielavia terrestris* (SEQ ID NO: 78), *Madurella mycetomatis* (SEQ ID NO: 79), *Neurospora crassa* (SEQ ID NO: 80), *Verticillium dahlia* (SEQ ID NO: 81), and/or *Gibberella zeae* (SEQ ID NO: 82). The GE yeast can express a trehalase polypeptide with a sequence identity of at least 70%, 75%, 80%, 85%, 90%, 95%, or 97% to one or more of any of these amino acid sequences.

In some embodiments, the GE yeast encodes a heterologous trehalase polypeptide from a species that includes a signature pattern or motif, i.e., a subset of amino acids in the full sequence for the trehalase polypeptide that is identical or nearly identical to an amino acid subset of a trehalase from another species. For example, each of the trehalases from SEQ ID NO: 1 (*Kluyveromyces lactis*), SEQ ID NO: 2 (*Candida parapsilosis*), and SEQ ID NO: 3 (*Candida glabrata*) include the following amino acid motif: QPYVANGYIGSRIPN (SEQ ID NO: 83). In some embodiments, the GE yeast expresses a trehalase polypeptide having at least 70%, at least 80%, at least 85%, at least 90%, or 100% sequence identity to SEQ ID NO: 83. Further, each of the trehalases from SEQ ID NO: 1 (*Kluyveromyces lactis*), SEQ ID NO: 2 (*Candida parapsilosis*), and SEQ ID NO: 3 include both of the following motifs at greater than 90% sequence identity: GVAGLSSDSYGGMVFWD (SEQ ID NO: 84) and NITLEYSGMNSSVEIKQADV (SEQ ID NO: 85). In some embodiments, the GE yeast expresses a trehalase polypeptide having a portion of the sequence with at least 70%, at least 75%, at least 80%, at least 85%, at least 90%, at least 94%, or 100% sequence identity to SEQ ID NO: 84 and/or SEQ ID NO: 85. The following amino acid sequence is included in most or all acid trehalases: NITLEYSGMNSSV (SEQ ID NO: 86). In some embodiments, the GE yeast expresses a trehalase polypeptide having a portion of the sequence with at least 76%, at least 84%, at least 92%, or 100% sequence identity to SEQ ID NO: 86. *S. cerevisiae* is known to have native trehalase genes that express two types of trehalase, both an acid trehalase (AT) and a neutral trehalase (NT), which are characterized according to the optimal pH of expression. However, both native trehalases are heavily regulated and exhibit low activity. In low- or non-stress conditions, very little of these trehalases are made. Further, these trehalases may be confined to the vacuole. (for discussion of *S. cerevisiae* trehalases see, e.g., Parrou, J. L., Jules, M., Beltran, G., Francois, J. Acid trehalase in yeasts and filamentous fungi: Localization, regulation and physiological function (2005) FEMS Yeast Research, 5 (6-7), pp. 503-511; Eleutherio, E., Panek, A., De Mesquita, J. F., Trevisol, E., Magalhaes, R. Revisiting yeast trehalose metabolism (2015) Current Genetics, 61 (3), pp. 263-274).

Zilli et al. described the heterologous expression of the *Candida glabrata* trehalase in *Saccharomyces* (Zilli, D. M. W., Lopes, R. G., Alves, S. L., Banos, L. M., Miletti, L. C., Stambuk, B. U. Secretion of the acid trehalase encoded by the CgATH1 gene allows trehalose fermentation by *Candida glabrata* (2015) Microbiological Research, 179, pp. 12-19). However, the yeast strain in Zilli that included the *Candida glabrata* trehalase produced very low amounts of ethanol, i.e., an amount of ethanol not useful for a commercial process. The GE yeasts of the present invention can produce significantly higher, commercially useful ethanol amounts.

In one aspect, the GE yeast of the present invention expresses a trehalase that is secreted extracellularly in significant amounts, rather than being expressed and bound in a vacuole, as is seen in the native *S. cerevisiae* trehalase. Accordingly, the expressed trehalase can act on extracellular trehalose in the fermentation broth, i.e., trehalose produced as a metabolite by the yeast during fermentation. In some embodiments, the GE yeast secretes more trehalase than a wild type yeast, but does not make an amount of trehalase that causes a significant metabolic burden to the yeast, i.e., the yeast makes enough trehalase to consume most or all of the trehalose produced by the cell without causing other issues that negatively affect fermentation performance. In some embodiments, the yeast can include a promoter that is associated with preventing the yeast from making an amount of trehalase that would cause a metabolic burden to the cell, or that would otherwise negatively affect fermentation performance.

For the purposes of this disclosure, in one aspect, a trehalase is an enzyme from EC 3.2.1.28. Accordingly, a trehalase is any enzyme for which the primary activity is hydrolysis of trehalose. In one aspect, a trehalase is any enzyme that exhibits significant activity on trehalose within a reasonable time frame.

In one aspect, the expression of trehalase in the GE yeast can be optimized or improved by including a peptide signal sequence, i.e., a leader sequence, which is different from the wild type leader sequence associated with a certain trehalase. In some embodiments, the signal peptide is a MFα2 signal sequence. In one aspect, an expressed trehalase protein of the disclosure can include a signal sequence having about 79% or greater, 84% or greater, 89% or greater, or 94% or greater sequence identity to SEQ ID NO: 4, which is derived from the N-terminus the *Saccharomyces cerevisiae* mating factor alpha 2 gene (Sc MFα2). In some embodiments, the Sc MFα2 SS sequence is as follows: MKFISTFLTFILAAVSVTA (SEQ ID NO: 4). The Sc MFα2 sequence is from the gene YGL089C (YGL089C), whereas MFα1 is coded by the gene YPL187W MFα1 and MFα2 are pheromones secreted by MATa cells. Sc MFα2-secretion signal modified trehalase polypeptides and engineered yeast strains that express the same are described in International Patent Application serial no. PCT/US2016/016822, and filed 5 Feb. 2016 (Miller, et al.). The *Saccharomyces cerevisiae* mating factor alpha 2 (Sc MFα2) secretion signal is described in U.S. Pat. No. 4,546,082 (Kurjan et al.). In some embodiments, the yeast includes a gene for expressing a trehalase encoded by the yeast has a sequence identity of at least 75, 80, 85, 90, 95, or 97% to at least one of the following polypeptide sequences: SEQ ID NO: 8, SEQ ID NO: 11, SEQ ID NO: 14, or SEQ ID NO: 92 (i.e., a trehalase having the Sc MFα2 instead of its native secretion signal.

In some embodiments, the MFα2 secretion signal is a *K. lactis* acid trehalase secretion signal with at least 80%, 85%, 90%, or 95% sequence identity to the polypeptide sequence of SEQ ID NO: 8. In some embodiments, the MFα2 secretion signal is a *C. parapsilosis* acid trehalase secretion signal with at least 80%, 85%, 90%, or 95% sequence identity to the polypeptide sequence of SEQ ID NO: 11. In some embodiments, the MFα2 secretion signal is a *C. glabrata* acid trehalase secretion signal with at least 80%, 85%, 90%, or 95% sequence identity to the polypeptide sequence of SEQ ID NO: 14.

This disclosure is not meant to be limited to any specific trehalase polypeptide, and the GE yeast can include a gene to express any trehalase polypeptide that is useful for fermentation processes. In some embodiments, an acid trehalase gene is integrated into the GE yeast. In some embodiments, a neutral trehalase gene is integrated into the GE yeast. In some embodiments, the GE yeast can include both an acid trehalase gene and a neutral trehalase gene. As would be understood by a person skilled in the art, promotor or leader sequences can be chosen to optimize the expression of an acid trehalase and/or a neutral trehalase depending on the expected pH of the fermentation broth, other characteristics of a fermentation process, and/or other characteristics of the GE yeast itself.

Further, this disclosure is not meant to be limited to any specific leader sequence for the one or more trehalase genes that are integrated into the GE yeast. Any secretion signal sequence described herein can be used with any trehalase polypeptide described herein, i.e., this disclosure is meant to include every combination of leader sequences and trehalase polypeptides. Accordingly, the GE yeast can include a leader sequence for a trehalase that is heterologous to the GE yeast itself. Such a leader sequence may be the wild type associated with the heterologous trehalase or may be heterologous to both the GE yeast and to the species from which the trehalase is taken. In some embodiments, a leader sequence native to a different gene in the GE yeast can be used with a heterologous trehalase.

For the purposes of this disclosure, when identifying the percent sequence identity of a sequence to any trehalase polypeptide it should be understood that the native leader sequence amino acids are not included in the calculation of sequence identity. However, if the leader sequence amino acids cannot be readily and completely ascertained using such methods, the percent sequence identity is calculated using the full trehalase polypeptide sequence, i.e., including the native leader sequence. For example, SEQ ID NO: 87 is the polypeptide for *Magnaporthe grisea* trehalase with its native leader sequence, and SEQ ID NO: 88 is the polypeptide for *Magnaporthe grisea* trehalase without its native leader sequence. Other examples of trehalase polypeptides without a secretion leader sequence include SEQ ID NO: 89 (*Candida glabrata*), SEQ ID NO: 90 (*Candida parapsilo-* sis), and SEQ ID NO: 91 (*Kluyveromyces lactis*). Accordingly, in some embodiments, the GE yeast encodes a heterologous trehalase polypeptide having a sequence identity of at least 75%, at least 80%, at least 90%, at least 95%, at least 97%, or 100% to SEQ ID NO: 88, SEQ ID NO: 89, SEQ ID NO: 90, or SEQ ID NO: 91. In some embodiments, the GE yeast encodes a heterologous trehalase polypeptide having a sequence identity of at least 75%, at least 80%, at least 90%, at least 95%, at least 97%, or 100% to any of the following sequences which represent trehalase polypeptides with a MFα2 secretion signal: the combination of SEQ ID NO: 4 with SEQ ID NO: 88; the combination of SEQ ID NO: 4 with SEQ ID NO: 89; the combination of SEQ ID NO: 4 with SEQ ID NO: 90; or the combination of SEQ ID NO: 4 with SEQ ID NO: 91.

While not wishing to be bound by theory, sequence analysis software predicts that the native leader (signal peptide) for all three of the *Kluyveromyces lactis, Candida parapsilosis*, and *Candida glabrata* trehalases is a transmembrane domain, not a secretion signal. This suggests that the trehalases are pushed out of the cell membrane into the periplasmic space, i.e., the space between the cell membrane and the cell wall. However, these trehalases are likely still anchored to the cell membrane. The replacement of the native signal peptide with the MFα2 secretion signal is likely untethering the protein from the membrane, which enables extracellular secretion.

He et al. (He, S., Bystricky, K., Leon, S., Francois, J. M., Parrou, J. L. The *Saccharomyces cerevisiae* vacuolar acid trehalase is targeted at the cell surface for its physiological function (2009) FEBS Journal, 276 (19), pp. 5432-5446) describes replacing the native *Saccharomyces* acid trehalase signal peptide with the secretion leaders from 2 other genes. However, significant amounts of the protein appear to be in the vacuole regardless of the signal peptide in that study.

In one aspect, the expression of trehalase in the GE yeast can be optimized or improved by including a promoter. In some embodiments, the promoter is a TDH3 promoter. In one embodiment, the promoter is a *S. cerevisiae* TDH3 promoter with at least 80%, 85%, 90%, or 95% sequence identity to SEQ ID NO: 5. In some embodiments, the promoter is a SAM2 promoter. In some embodiments, the promoter is a *S. cerevisiae* SAM2 promoter with at least 80%, 85%, 90%, or 95% sequence identity to SEQ ID NO: 112.

In one aspect, the expression of a trehalase by the GE yeast addresses a significant problem often associated with GE yeasts used for producing bioproducts via fermentation. Yeasts typically produce more trehalose when stressed. Some fermentation process conditions can cause stress in GE yeasts used for bioproduct production. For example, some fermentation processes are associated with high temperatures, which causes stress on the yeast. High ethanol or other bioproduct concentrations and/or high salt concentrations can also cause stress that increases trehalose production. The expression of heterologous enzymes in GE yeasts can also lead to an increase in trehalose production because such enzyme expression can cause stress on the yeast. In particular, engineered yeasts expressing a glucoamylase are known to exhibit higher trehalose production.

However, the trehalase-expressing yeasts of the present invention can address this problem by reducing or eliminating the trehalose produced by yeasts used for bioproduct fermentation. The trehalose is converted to glucose and can be used by the yeasts as a carbon source for metabolic needs and/or bioproduct formation. Accordingly, carbon used by the yeast to produce trehalose can be effectively recycled by the yeast to make proteins or bioproducts, thereby improving the overall performance of a fermentation process using the yeast.

In some studies, native trehalase genes have been deleted or disrupted in a yeast in an attempt to reduce stress issues and increase ethanol tolerance, contrary to the teachings of the present disclosure (see, e.g., Trevisol, E. T. V., Panek, A. D., Mannarino, S. C., Eleutherio, E. C. A., The effect of trehalose on the fermentation performance of aged cells of *Saccharomyces cerevisiae* (2011) Applied Microbiology and Biotechnology, 90 (2), pp. 697-704, discussing the deletion of either Acid Trehalase (ATH1) or Neutral Trehalase (NTH1) and the resulting increased ethanol tolerance). However, the GE yeasts of the present invention which secrete heterologous trehalases have been surprisingly shown to improve ethanol production performance compared to wild type or other engineered yeasts.

In some embodiments, the GE yeast can further include heterologous genes for expressing polypeptides other than trehalase. In some embodiments, the GE yeast can include one or more heterologous genes for expressing any or all of the following: an amylase, for example a glucoamylase (EC 3.2.1.3), proteins associated with lactate consumption (for example, a heterologous gene encoding a monocarboxylic/ monocarboxylate transporter and/or one or more heterologous genes encoding lactate dehydrogenase (cytochrome) (classified as EC 1.1.2.3 or 1.1.2.4)), an isomaltase (EC 3.2.1.10), and sugar transporter proteins. In some embodiments, the GE yeast can further include one or more promoters and/or leader sequences useful for optimizing expression of such polypeptides. In some embodiments, the GE yeast can include 2 or more copies of any of the heterologous genes described herein.

Glucoamylases (E.C. 3.2.1.3) are amylolytic enzymes that hydrolyze 1,4-linked a-D-glucosyl residues successively from the nonreducing end of oligo- and polysaccharide chains with the release of D-glucose. In some embodiments, the GE yeast encodes for both a heterologous trehalase and a heterologous glucoamylase.

The above genetic modifications are further described in the following references, all of which are hereby incorporated by reference in their entirety: WO 2016/127083, filed 5 Feb. 2016 (MODIFIED GLUCOAMYLASE ENZYMES AND YEAST STRAINS HAVING ENHANCED ETHANOL PRODUCTION); WO 2016/160584, filed 25 Mar. 2016 (GLUCOAMYLASE-MODIFIED YEAST STRAINS AND METHODS FOR BIOPRODUCTPRODUCTION); PCT/US16/067314, filed 16 Dec. 2016, published as WO 2017/106739 (SUGAR TRANSPORTER-MODIFIED YEAST STRAINS AND METHODS FOR BIOPRODUCT PRODUCTION); U.S. Pat. App. 62/371,681, filed 5 Aug. 2016, published as WO 2018/027131 (LEADER-MODIFIED GLUCOAMYLASE POLYPEPTIDES AND ENGINEERED YEAST STRAIN HAVING ENHANCED BIOPRODUCT PRODUCTION); U.S. Pat. App. 62/395,792, filed 16 Sep. 2016, published as WO 2018/053230 (GENETICALLY MODIFIED LACTATE-CONSUMING YEASTS AND FERMENTATION PROCESSES USING SUCH GENETICALLY MODIFIED YEASTS).

In some embodiments, the GE yeast can include genes having the following SEQ IDs and/or which express one or more of any of the following polypeptide SEQ IDs, which include embodiments of the genetic modifications described in the references above: greater than 50%, 60%, 70%, 75%, 80%, 85%, 90%, or 95% sequence identity to SEQ ID NO: 16 (amino acids 19-515 of *Saccharomycopsis fibuligera* glucoamylase (GA) polypeptide), SEQ ID NO: 17 (amino acids 26-604 of *Rhizopus oryzae* GA polypeptide), SEQ ID NO: 18 (amino acids 19-639 of *Aspergillus shirousami* GA polypeptide), and/or SEQ ID NO: 19 (amino acids 21-636 of *Aspergillus terreus* GA polypeptide); greater than 75%, 80%, 81%, 85%, 90%, or 95% or greater sequence identity to SEQ ID NO: 108 (*Rhizopus microsporus* GA polypeptide); greater than 80%, 85%, 90%, 95%, or 97% or greater sequence identity to SEQ ID NO: 109 (*Rhizopus delemar* GA polypeptide); greater than 80%, 85%, 90%, or 95%, or greater sequence identity to SEQ ID NO: 20 (*Saccharomyces mikatae* sugar transporter polypeptide); greater than 50%, 60%, 70%, 80%, 85%, 90%, or 95%, or greater sequence identity to SEQ ID NO: 21 (*S. cerevisiae* MAL11); an amino acid sequence with a sequence identity of at least 65%, 70%, 75%, 80%, 85%, 90%, 95%, 97%, or 99% to at least one of the following amino acid sequences: SEQ ID NO: 22, SEQ ID NO: 23, SEQ ID NO: 24, SEQ ID NO: 25, or SEQ ID NO: 26 (a heterologous monocarboxylate/proton symporter amino acid, e.g., a JEN1 symporter, from *Issatchenkia orientalis, Saccharomyces cerevisiae, Kluyveromyces lactis, Kluyveromyces dobzhanskii,* or *Kluyveromyces marxianus*); a polypeptide having an amino acid sequence with a sequence identity of at least 50%, 55%, 60%, 65%, 70%, 75%, 80%, 85%, 90%, 95%, 97%, or 99% to at least one of the following amino acid sequences: SEQ ID NO: 27, SEQ ID NO: 28, SEQ ID NO: 29, SEQ ID NO: 30, SEQ ID NO: 31, SEQ ID NO: 32, or SEQ ID NO: 33 (a cytochrome b2 (CYB2) polypeptide from *Saccharomyces cerevisiae, Issatchenkia orientalis, Saccharomyces kluyveri, Saccharomyces bayanus, Zygosaccharomyces rouxii, Kluyveromyces lactis,* or *Kluyveromyces dobzhanskii*); or an amino acid sequence with a sequence identity of at least 50%, 55%, 60%, 65%, 70%, 75%, 80%, 85%, 90%, 95%, 97%, or 99% to at least one of the following amino acid sequences: SEQ ID NO: 34, SEQ ID NO: 35, SEQ ID NO: 36, SEQ ID NO: 37, SEQ ID NO: 38, SEQ ID NO: 39, SEQ ID NO: 40, or SEQ ID NO: 41 (a D-lactate dehydrogenase (DLD) polypeptide from *Saccharomyces cerevisiae, Issatchenkia orientalis, Saccharomyces kluyveri, Saccharomyces bayanus, Aspergillus fumigatus, Kluyveromyces lactis, Kluyveromyces dobzhanskii,* or *Kluyveromyces marxianus*). In one aspect, the residues and associated positions of Lys349, Tyr143, Tyr254, and His373 are conserved in SEQ ID NO: 27, SEQ ID NO: 28, SEQ ID NO: 29, SEQ ID NO: 30, SEQ ID NO: 31, SEQ ID NO: 32, or SEQ ID NO: 33. Any of the above SEQ IDs encoded by the GE yeast can be heterologous as defined herein.

As would be understood by a person skilled in the art, modifying a host yeast to include multiple heterologous genes can result in an unpredictable effect on the host yeast. For example, the GE yeast containing multiple heterologous genes, i.e., 2 or more heterologous genes expressing different classes of enzymes or other proteins, can result in negative metabolic effects on the yeast, adversely affect the heat tolerance of the yeast, or adversely affect the amount of ethanol produced by the yeast. However, it has been surprisingly found that, in at least some embodiments described herein, the inclusion of a heterologous trehalase gene does not have any significant adverse effects on the GE yeast. Instead, the GE yeast including multiple traits, i.e., multiple different heterologous genes, performs better in an ethanol fermentation than a yeast that does not include all of the multiple traits.

In one aspect, it has been found that including one or more heterologous enzyme-expressing genes, for example a glucoamylase-expressing gene, in a yeast can result in increased trehalose production by the yeast compared to the unmodified host cell. Further, yeasts genetically modified by mutagenesis to improve heat tolerance, ethanol tolerance, or other characteristics have also been found to exhibit increased trehalose production compared to the pre-mutated host cell. However, the GE yeasts of the present invention can exhibit lower trehalose production compared to the unmodified host cell, or a host cell having all of the same modifications except for the inclusion of an integrated heterologous trehalase gene. In some embodiments, even if trehalose production is similar when comparing the GE yeast of the present invention with a yeast that does not contain a heterologous trehalase, the trehalase-expressing GE yeast can produce more ethanol by being able to convert most or all of the trehalose produced to glucose, which can be further converted to ethanol and/or used for metabolism by the yeast.

Further, in one aspect, the GE yeast can reduce or eliminate the need for adding certain exogenous enzymes to the fermentation, namely any of the enzymes expressed by the yeast as described herein such as trehalase and glucoamylase, resulting in significant cost savings.

In one aspect, the expression of trehalase by the GE yeast can result in higher ethanol production during fermentation. In some embodiments, the GE yeast can produce at least 0.1, 0.2, 0.3, 0.4, 0.5, 0.6, 0.7, 0.8, 0.9, 1.0, 1.1, 1.2, 1.3, 1.4, or 1.5% more ethanol than a yeast that does not express a heterologous trehalase. In some embodiments, the GE yeast expressing a heterologous trehalase can produce ethanol at a titer of at least 70, 75, 80, 85, 90, 95, 100, 105, 110, 115, 120, 125, 130, or 135 g/L or more. In some embodiments, the yeast is a GE yeast that expresses trehalase and is useful for fermenting cellulosic or hemi-cellulosic media. In such embodiments, the ethanol titer can be lower than in other ethanol production processes and still be a commercially viable process. For example, such a trehalase-expressing yeast can produce an ethanol titer of at least 40, 45, 50, 55, 60, or 65 g/L.

In one aspect, the GE yeast expresses a sufficient amount of trehalase to convert at least 25, 33, 50, 60, 70, 80, or 90% of the trehalose produced or otherwise present in the fermentation broth to glucose by the end of fermentation. In one aspect, the GE yeast expresses a sufficient amount of trehalase to reduce the amount of trehalose in the fermentation broth to less than 0.5, 1, 1.5, 2, 2.5, 3, 3.5, 4, 4.5, 5, 6, 7, 8, 9, or 10 g/L by the end of fermentation. In some embodiments, the GE yeast expresses a sufficient amount of trehalase to reduce the amount of trehalose in the fermentation broth to less than 0.5, 1, 1.5, 2, 2.5, 3, 3.5, 4, 4.5, 5, 6, 7, 8, 9, or 10 g/L without the need for adding exogenous trehalase to the fermentation, i.e., all of the trehalase necessary for reducing the amount of trehalose to such levels is secreted by the yeast. In some embodiments, the GE yeast can reduce the amount of trehalose to any of the preceding levels when the ethanol titer at least 40 g/L, 45 g/L, 50 g/L, 55 g/L, 60 g/L, 65 g/L, 70 g/L, 75 g/L, 80 g/L, 85 g/L, 90 g/L, 95 g/L, 100 g/L, 105 g/L, 110 g/L, 115 g/L, 120 g/L, 125 g/L, 130 g/L, or 135 g/L. In one aspect, the GE yeast expresses a sufficient amount of trehalase to convert a total of at least 1, 2, 3, 4, 5, 6, 7, 8, 9, 10 g/L or more of the trehalose produced and/or present during a fermentation process before the end of the fermentation process. Although it is contemplated that most of the trehalase made by the GE yeast is secreted extracellularly to act on trehalose outside the yeast cell, i.e., trehalose present in the fermentation broth, it is also contemplated that a portion of the trehalase made by the GE yeast can remain in the cell where it can act on intracellular trehalose. In one aspect, the GE yeast can include genetic modifications associated with reduced amounts of by-products, including glycerol. These genetic modifications (or combination of genetic modifications) may be referred to herein as a "glycerol-reduction trait." In one aspect, the GE yeast includes the following modifications: a recombinant nucleic acid encoding a glyceraldehyde-3-phosphate dehydrogenase (E.C. 1.2.1.9) and reduced or eliminated expression of a gene encoding a glycerol-3-phosphate phosphatase (E.C. 3.1.3.21). These modifications are further described in U.S. Application No. 62/648,679, which is hereby incorporated by reference in its entirety. In one aspect, the GE yeast includes the following modification: a recombinant nucleic acid encoding a glyceraldehyde-3-phosphate dehydrogenase (E.C. 1.2.1.9).

Engineered yeast strains described herein can include genetic modifications in one or more enzymes involved in glycerol production. For example, engineered yeast strains described herein can have reduced or eliminated expression of one or more genes encoding a glycerol-3-phosphate phosphatase (Gpp; corresponding to E.C. 3.1.3.21; also known as "glycerol-1-phosphatase"). Glycerol-3-phosphate phosphatase enzymes hydrolyze glycerol-3-phosphate into glycerol, and thereby regulate the cellular levels of glycerol-3-phosphate, a metabolic intermediate of glucose, lipid and energy metabolism (Mugabo et al., PNAS (2016) 113:E430-439).

*Saccharomyces cerevisiae* (*S. cerevisiae*) has two glycerol-3-phosphate phosphatase paralogs, referred to as Gpp1p and Gpp2p, encoded by the GPP1 (UniProt No. P41277) and GPP2 (UniProt No. P40106) genes, respectively (Norbeck et al. (1996) J. Biol. Chem. 10 271(23):13875-81; Pahlman et al. (2001) J. Biol. Chem. 276(5):3555-63). In some embodiments, the GE yeast has reduced or eliminated expression of GPP1. In other embodiments, the GE yeast has reduced or eliminated expression of GPP2. In other embodiments, the GE yeast has reduced or eliminated expression of both GPP1 and GPP2.

It should be appreciated that any means of achieving reduced or eliminated expression of a gene encoding a glycerol-3-phosphate phosphatase enzyme is compatible with aspects of the invention. For example, reduced or eliminated expression of a gene encoding a glycerol-3-phosphate phosphatase can be achieved by disrupting the sequence of the gene and/or one or more regulatory regions controlling expression of the gene, such as by introducing one or more mutations or insertions into the sequence of the gene or into one or more regulatory regions controlling expression of the gene.

In some embodiments, expression of a gene encoding a glycerol-3-phosphate phosphatase enzyme, such as the GPP1 gene, is reduced by at least approximately 10%, 20%, 30%, 40%, 50%, 60%, 70%, 80%, 90% or 100%. In some embodiments, expression of the gene encoding a glycerol-3-phosphate phosphatase enzyme, such as the GPP1 gene is eliminated. Expression of a gene encoding a glycerol-3-phosphate phosphatase enzyme, such as a GPP1 gene, can be eliminated by any means known to one of ordinary skill in the art, such as by insertion of a nucleic acid fragment into the GPP1 locus or regulatory regions surrounding the GPP1 locus.

In some embodiments, the GE yeast is diploid and has reduced or eliminated expression of both copies of the GPP1 gene. In some embodiments, the GE yeast is diploid and contains a deletion and/or insertion in both copies of the GPP1 gene.

Engineered yeast described herein can have reduced or eliminated expression of one or more genes encoding a glyceraldehyde-3-phosphate dehydrogenase (Gpd; corresponding to E.C.1.2.1.12). *S. cerevisiae* has two glyceraldehyde-3-phosphate dehydrogenases, referred to as Gpd1p and Gpd2p, encoded by the GPD1 (UniProt No. Q00055) and GPD2 (UniProt No. P41911) genes, respectively. In some embodiments, the GE yeast has reduced or eliminated expression of GPD1. In other embodiments, the GE yeast has reduced or eliminated expression of GPD2. In other embodiments, the GE yeast has reduced or eliminated expression of both GPD1 and GPD2.

It should be appreciated that any means of achieving reduced or eliminated expression of a gene encoding a glyceraldehyde-3-phosphate dehydrogenase enzyme is compatible with aspects of the invention. For example, reduced or eliminated expression of a gene encoding a glyceraldehyde-3-phosphate dehydrogenase can be achieved by disrupting the sequence of the gene and/or one or more regulatory regions controlling expression of the gene, such as by introducing one or more mutations or insertions into the sequence of the gene or into one or more regulatory regions controlling expression of the gene.

In some embodiments, expression of a gene encoding a glyceraldehyde-3-phosphate dehydrogenase enzyme, such as the GPD1 gene, is reduced by at least approximately 10%, 20%, 30%, 40%, 50%, 60%, 70%, 80%, 90% or 100%. In some embodiments, expression of the gene encoding a glyceraldehyde-3-phosphate dehydrogenase enzyme, such as the GPD1 gene is eliminated. Expression of a gene encoding a glyceraldehyde-3-phosphate dehydrogenase enzyme, such as a GPD1 gene, can be eliminated by any means known to one of ordinary skill in the art, such as by insertion of a nucleic acid fragment into the GPD1 locus or regulatory regions surrounding the GPD1 locus.

In some embodiments, the GE yeast described herein, such as *S. cerevisiae*, is diploid and has reduced or eliminated expression of both copies of the GPD1 gene. In some embodiments, the GE yeast is diploid and contains a deletion and/or insertion in both copies of the GPD1 gene. In other embodiments, the GE yeast has reduced or eliminated expression of one copy of the GPD1 gene.

In some embodiments, engineered yeast described herein, such as *S. cerevisiae*, has reduced or eliminated expression of GPP1 and/or GPP2, and also has reduced or eliminated expression of GPD1 and/or GPD2. In certain embodiments, engineered yeast described herein, such as *S. cerevisiae*, has reduced or eliminated expression of two copies of GPP1 and also has reduced or eliminated expression of one copy of GPD1.

Engineered yeast described herein recombinantly express one or more nucleic acids encoding a glyceraldehyde-3-phosphate dehydrogenase enzyme (gapN; corresponding to E.C.1.2.1.9; also known as "NADP-dependent non-phosphorylating glyceraldehyde-3-phosphate dehydrogenase"). GapN enzymes convert D-glyceraldehyde 3-phosphate to 3-phospho-D-glycerate (Rosenberg et al., *J Biol Chem* (1955) 217:361-71).

It should be appreciated that the recombinant nucleic acid encoding a gapN enzyme can come from any source. An engineered yeast that recombinantly expresses a nucleic acid encoding a gapN enzyme may or may not contain an endogenous gene encoding a gapN enzyme.

In some embodiments, the engineered yeast that recombinantly expresses a nucleic acid encoding a gapN enzyme does not contain an endogenous copy of a gene encoding a gapN enzyme. Accordingly, in such embodiments, the nucleic encoding a gapN enzyme is derived from a species or organism different from the engineered yeast.

In other embodiments, the engineered yeast that recombinantly expresses a nucleic acid encoding a gapN enzyme does contain an endogenous copy of a gene encoding a gapN enzyme. In some such embodiments, the endogenous copy of the gene encoding a gapN enzyme, or a regulatory region for the gene, such as a promoter, is engineered to increase expression of the gene encoding a gapN enzyme. In other such embodiments, a nucleic acid encoding a gapN enzyme is introduced into the yeast. In such embodiments, the nucleic acid encoding the gapN enzyme that is introduced into the yeast may be derived from the same species or organism as the engineered yeast in which it is expressed, or may be derived from a different species or organism than the engineered yeast in which it is expressed.

In some embodiments, the recombinant nucleic acid encoding a gapN enzyme comprises a *Bacillus cereus* gene (e.g., GAPN, corresponding to UniProt No. Q2HQS1). In some embodiments, the recombinant nucleic acid encoding a GapN enzyme, or a portion thereof, is codon-optimized. In some embodiments, the recombinant nucleic acid encoding a gapN enzyme, or a portion thereof, comprises SEQ ID NO: 110.

In some embodiments, the recombinant nucleic acid encoding a gapN enzyme, or portion thereof, has at least or about 50%, at least or about 60%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, at least or about 98%, at least or about 99%, at least or about 99.5%, or at least or about 99.9% sequence identity to the sequence of SEQ ID NO: 110.

In some embodiments the gapN protein comprises SEQ ID NO: 111. In some embodiments the gapN protein has at least or about 50%, at least or about 60%, at least or about 70%, at least or about 75%, at least or about 80%, at least or about 81%, at least or about 82%, at least or about 83%, at least or about 84%, at least or about 85%, at least or about 86%, at least or about 87%, at least or about 88%, at least or about 89%, at least or about 90%, at least or about 91%, at least or about 92%, at least or about 93%, at least or about 94%, at least or about 95%, at least or about 96%, at least or about 97%, at least or about 98%, at least or about 99%, at least or about 99.5%, or at least or about 99.9% sequence identity to the sequence of SEQ ID NO: 111.

One of ordinary skill in the art would understand that a GAPN gene could be derived from any source and could be engineered using routine methods, such as to improve expression in a host cell. Further, one of ordinary skill in the art would understand that a GAPN gene could be inserted at any suitable locus in the host cell.

As described herein, in one aspect, the GE yeast can include multiple genetic modifications without exhibiting a significant change to fermentation performance and/or a change in the health of the yeast cell during fermentation. It has been surprisingly found that a GE yeast including the trehalase trait described herein in combination with a glucoamylase expressing trait, and/or a glycerol reduction trait (i.e., a GE yeast that produces less and/or consumes more glycerol than a comparative wild type yeast) can reach higher ethanol titers than any other currently available ethanol-producing yeast strain without demonstrating any significant negative effects associated with the performance of the GE yeast. In one aspect, the inclusion in the GE yeast of one or more of the genetic modifications described herein does not negatively affect the performance characteristics in a fermentation. In some embodiments, the fermentation performance characteristics which are not significantly affected include, but are not limited to: average rate of production of ethanol; the maximum ethanol titer on a given substrate, e.g., a given corn mash; the time for the GE yeast to produce the maximum ethanol titer; and the time for the GE yeast to produce a commercially relevant titer (e.g., at least 110 g/L, at least 120 g/L, or at least 130 g/L). Commercially relevant fermentation times, i.e., a fermentation cycle time that can produce a commercially relevant titer while enabling a manufacturer to make a profit, can vary depending on the specific ethanol plant. However, for the purposes of this disclosure, commercially relevant fermentation times are considered to be 48 hours or less, 40 hours or less, or 36 hours or less. A yeast strain that cannot reach a commercially relevant ethanol titer within 48 hours and/or exhibits a reduced rate of production of ethanol at any time within 48 h as compared to a wild type strain such as Ethanol Red™ is considered to exhibit a "fermentation penalty." In some embodiments, the GE yeasts of the present invention can exhibit a significantly reduced fermentation penalty and/or a statistically insignificant fermentation penalty as compared to a commercially relevant wild type yeast strain.

In some embodiments, the GE yeast include a recombinant nucleic acid encoding a glyceraldehyde-3-phosphate dehydrogenase (E.C. 1.2.1.9) and reduced or eliminated expression of a gene encoding a glycerol-3-phosphate phosphatase (E.C. 3.1.3.21), and also a heterologous gene encoding a trehalase. In some embodiments, the GE yeast comprises a recombinant nucleic acid encoding a glyceraldehyde-3-phosphate dehydrogenase (GAPN, E.C. 1.2.1.9), and also a heterologous gene encoding a trehalase. In some embodiments, the GE yeast can include a heterologous gene encoding a trehalase and a heterologous gene encoding a glucoamylase.

In some embodiments, the GE yeast can include a heterologous gene encoding a trehalase; a heterologous gene encoding a glucoamylase; and a recombinant nucleic acid encoding a glyceraldehyde-3-phosphate dehydrogenase (E.C. 1.2.1.9) and reduced or eliminated expression of a gene encoding a glycerol-3-phosphate phosphatase (E.C. 3.1.3.21). In some embodiments, the GE yeast can include a heterologous gene encoding a trehalase; a heterologous gene encoding a glucoamylase; and a recombinant nucleic acid encoding a glyceraldehyde-3-phosphate dehydrogenase (E.C. 1.2.1.9). It has been surprisingly shown that a GE yeast which includes a trehalase-expressing trait, a glucoamylase-expressing trait, and/or a glycerol reduction trait (e.g., a GAPN-expressing trait) can produce significantly higher amounts of ethanol than other yeast strains without exhibiting any significant negative performance characteristics typically associated with the genetic modification of an ethanol-producing yeast.

In some embodiments, the heterologous gene encoding a trehalase can be a heterologous gene encoding a trehalase (EC 3.2.1.28) polypeptide having a sequence identity of at least 80%, 85%, 90%, or 95% to any one of the following polypeptide sequences: SEQ ID NO: 1 (*K. lactis*), SEQ ID NO: 2 (*C. parapsilosis*), SEQ ID NO: 3 (*C. glabrata*), or SEQ ID NO: 87 (*M. grisea*). In some embodiments, the heterologous gene encoding a glucoamylase in the GE yeast encodes for a glucoamylase polypeptide having a sequence identity of at least 70, 75, 80, 85, 90, or 95% to at least one of the following polypeptide sequences: SEQ ID NO: 16 (Sf GA), SEQ ID NO: 17 (Ro GA), SEQ ID NO: 108 (Rmic GA), or SEQ ID NO: 109 (*R. delemar* GA, i.e., Rdel GA).

The GE yeast can include any combination of specific heterologous trehalase genes and specific glucoamylase genes described herein. Non-limiting examples are a GE yeast including a heterologous trehalase gene from *M. grisea* and a heterologous GA gene from *R. microsporus*; a GE yeast including a heterologous trehalase gene from *M. grisea* and a heterologous GA gene from *S. fibuligera*; a GE yeast including a heterologous trehalase gene from *M. grisea* and a heterologous GA gene from *R. delemar*; a heterologous trehalase gene from *M. grisea* and a heterologous GA gene from *R. oryzae*; a GE yeast including a heterologous trehalase gene from *C. glabrata* and a heterologous GA gene from *R. microsporus*; a GE yeast including a heterologous trehalase gene from *C. glabrata* and a heterologous GA gene from *S. fibuligera*; a GE yeast including a heterologous trehalase gene from *C. parapsilosis* and a heterologous GA gene from *R. microsporus*; a GE yeast including a heterologous trehalase gene from *C. parapsilosis* and a heterologous GA gene from *S. fibuligera*; and a GE yeast including a heterologous trehalase gene from *C. parapsilosis* and a heterologous GA gene from *R. delemar*. In addition, any of the above examples of the GE yeast (and any other example of a GE yeast provided herein) can also include a version of a glycerol reduction (GR) as described herein. It should be understood that in any embodiment described herein, when the disclosure refers to a GE yeast including a heterologous gene from a certain species, that such genes in the GE yeast will encode for a polypeptide associated with that gene (non-limiting examples of such polypeptides, including versions of such polypeptides with and without native leader sequences, or with a non-native leader sequence, are provided in the sequence listing of this application).

It should be understood that the GE yeast can include any combination of traits described herein. For example, the GE yeast can express any trehalase, can also express any glucoamylase, and can also include any version of a glycerol reduction trait(s). In addition to these three traits (or any combination of two of these traits), the GE yeast can further express any isomaltase and/or can include a lactate consuming trait. It has been surprisingly found the GE yeast is capable of including a version of each and every trait described herein without exhibiting a significant fermentation penalty.

Fermentation Processes

In one aspect, the present invention relates to fermentation processes. In one aspect, the fermentation processes can be any process using an embodiment of the genetically modified yeasts described herein to produce a fermentation product. In some embodiments, the fermentation product is ethanol. In some embodiments, the fermentation product can be a fermentation product other than ethanol, for example, but not limited to, n-propanol, iso-propanol, n-butanol, iso-butanol, butadiene, or isoprene.

An exemplary fermentation process can include the steps of providing a fermentation medium that contains a carbon source, adding a yeast to the fermentation medium, fermenting the medium with the yeast to produce a bioproduct, and harvesting the bioproduct. In one aspect, the carbon source in the medium can include starches, sugars, organic acids, or a mixture thereof. In some embodiments, the sugars can include trehalose. In some embodiments, the medium can include lactate.

In one aspect, as would be understood by a person skilled in the art, the composition of the medium can vary during fermentation. For example, glucose or another hexose can be generated from oligomers during fermentation via enzymatic activity, then consumed. Accordingly, in some embodiments, the glucose content can be very low or even undetectable at some points of the fermentation if glucose is consumed by the yeast faster than it is generated from the glucose oligomers. In some embodiments, for example fed-batch fermentation, the medium can be continuously or semi-continuously supplemented with a feed stream, such as a vegetable process feed stream.

Accordingly, in one aspect, the concentrations of various components of the fermentation medium for the processes described herein can be an average concentration. Average concentrations of components can be calculated via known methods in the art, for example by taking the average of the concentration of a component in the fermentation medium at the start of fermentation and the concentration of the same component in the fermentation medium of the end of fermentation. Such a calculation of average can also account for the concentration of the component in any input and/or output streams during the fermentation process. Further, for a continuous fermentation process, the average concentration of a component can refer to the average concentration in any single vessel, or it can refer to the average concentration over the entire process, i.e., accounting for all feed streams and all output streams of the process.

In some embodiments, at least 5%, 10%, 15%, 20%, 25%, 30%, 35%, 35%, 40%, 45%, 50%, 55%, 60%, 65%, 70%, 75%, 80%, 85%, 90%, 95%, or 99% of the trehalose present in the fermentation medium and/or generated by the yeast during fermentation is consumed by the end of fermentation.

In some embodiments, the amount of trehalose in the fermentation medium at the end of fermentation is in the range of 0 to 10 g/L, 0 to 5 g/L, 0 to 4 g/L, 0 to 3 g/L, 0 to 1 g/L, 0 to 0.5 g/L, 0 to 0.1 g/L, 0.001 to 3 g/L, 0.001 to 1 g/L or 0.001 to 0.1 g/L. In some embodiments, the amount of trehalose in the fermentation medium at the end of fermentation is in the range of 0.5 to 5 g/L, 1 to 5 g/L, 0.5 to 4 g/L, 0.5 to 3 g/L, 0.5 to 2 g/L, or 0.1 to 2 g/L. In some embodiments, the amount of total trehalose in the fermentation medium at the end of fermentation is less than 10 g/L, 7.5 g/L, 5 g/L, 4 g/L, 3 g/L, 2 g/L, 1 g/L, 0.5 g/L, or 0.1 g/L.

In some embodiments, at least 0.1 g/L, 0.5 g/L, 1 g/L, 2 g/L, 3 g/L, 4 g/L, 5 g/L, 6 g/L, 7 g/L, 8 g/L, 9 g/L, or 10 g/L trehalose is converted to glucose in the process. The above parameters relating to trehalose conversion to glucose relate to a process that does not include exogenous trehalase enzyme, i.e., the conversion of trehalose is performed by trehalase expressed by the GE yeast. In some embodiments, the conversion of trehalose to glucose in any of the processes described herein is also associated with significant ethanol production, for example, at least 40, 45, 50, 55, 60, 65, 70, 75, 80, 85, 90, 95, 100, 105, 110, 115, 120, 125, 130, or 135 g/L. Further, in one aspect, the process of the present invention can be used to produce ethanol at commercially significant rates and/or titers. In some embodiments, the rate of ethanol produced can be 1 to 6 g $L^{-1}$ $h^{-1}$, 1 to 5.5 g $L^{-1}$ $h^{-1}$, or 1 to 5 g $L^{-1}$ $h^{-1}$.

In some embodiments, exogenous enzymes can be added to the process. For example, in some embodiments an exogenous trehalase, glucoamylase, and/or isomaltase can be added to the fermentation process.

In the present fermentation processes, the source of the trehalose is primarily from the yeast itself. Small amounts of trehalose may be present in the initial fermentation broth, however, most is likely made by the yeast. The amount of trehalose made by the yeast is related to the level of stress on the yeast. Accordingly, processes producing significant amounts of ethanol, such as the present processes, can cause ethanol-related stress on the yeast, thus increasing the amount of trehalose present in the fermentation broth. Stress that induces trehalose synthesis by the yeast can also be caused by other factors, such as heat or elevated salt concentration. In some embodiments, fermentation processes run using cellulosics as a substrate are associated with significant amounts of trehalose formation. These cellulosic ethanol processes can induce more stress on the yeast. Accordingly, the yeasts described herein can be particularly advantageous for fermentation processes using cellulosic materials as a primary fermentation substrate, or have significant amounts of cellulosic materials in addition to glucose or glucose oligomers.

Batch Fermentation Processes

In one aspect, the process of the present invention can be a batch fermentation process. In some embodiments, the batch process of the present invention is a dry-grind or dry-milling ethanol production process. Batch fermentation processes, including dry-grind ethanol processes are well-known in the art.

An exemplary batch fermentation process includes the steps of providing a fermentation medium that contains carbon sources such as carbohydrates and fermenting the medium using a genetically engineered yeast of a type described herein. In some embodiments, the yeast contains a heterologous trehalase gene. In some embodiments, the medium contains glucose or glucose oligomers at concentration of at least 0.5, 1, 2, or 3 g/L at the start of fermentation.

Continuous Fermentation Processes

In one aspect, the process of the present invention can be a continuous or a semi-continuous fermentation process. In some embodiments, the continuous process of the present invention is a wet corn milling ethanol production process. Continuous fermentation processes, including wet milling ethanol processes are well-known in the art. In some embodiments, a fermentation process having a continuous mode of operation includes multiple fermenters that operate in series in which a starch hydrolysate is supplied in the first fermenter, which is fed to second fermenter and so on until the starch hydrolysate is converted to ethanol. In some embodiments, continuous operation can be operated using between 1 to 10 or 2 to 7 fermenters. In some embodiments, a continuous fermentation process can be performed in a single vessel, in which feedstock can be added and product-containing broth can be removed on a continuous or semi-continuous schedule.

An exemplary continuous fermentation process for manufacturing ethanol comprises the following steps: providing an initial fermentation medium that contains glucose or glucose oligomers, fermenting the fermentation medium with a genetically modified yeast, and removing at least one output stream comprising ethanol from the fermentation medium.

In some embodiments, the initial fermentation medium is added to a pre-fermenter or growth fermenter vessel, where the genetically modified yeast is added and grown until a desired biomass is achieved. In some embodiments, the conditions of the process in the pre-fermenter are set to favor cell growth over fermentation product formation. In some embodiments, the contents of the pre-fermenter vessel can then be transferred to a second fermenter vessel. In the second fermenter vessel, the conditions of the process are set to favor the formation of fermentation product over cell growth. In some embodiments, additional fermentation medium is added to the second fermenter vessel, either in a single portion or in a continuous or semi-continuous manner. In some embodiments, the additional fermentation medium added to the second fermenter vessel contains lactate and/or other carbon sources. The second fermenter referred to above can also be referred to as a "propagator." In some embodiments, the contents of the second fermenter vessel can be transferred to a third fermenter vessel. The process conditions of the third fermenter vessel can be the same or different as the second fermenter vessel. In some embodiments, the contents of third fermenter vessel can be transferred to one or more additional fermenter vessels, as would be understood by a person skilled in the art of continuous fermentation processes. In some embodiments, the bioproduct, e.g., ethanol, is isolated from the contents of the final fermenter vessel.

In some embodiments, the average glucose concentration of the fermentation medium in the pre-fermenter vessel is in the range of 10 to 20 g/L. In some embodiments, the average glucose concentration of the fermentation medium in the second fermenter vessel is in the range of 30 to 40 g/L. In some embodiments, the average glucose concentration of the fermentation medium in the third fermenter vessel, or any additional fermenter vessel, is in the range of 30 to 40 g/L. In some embodiments, the average glucose concentration of the fermentation medium in the final fermenter vessel is in the range of 0 to 5 g/L. In some embodiments, the average glucose concentration of the fermentation medium in the pre-fermenter vessel, propagator vessel, or in any of the fermentation vessels is in the range of 0-5, 2-5, 1-10, 5-10, 5-15, 5-20, 10-20, 15-25, 20-30, 25-35, 30-40, or 35-45 g/L. In some embodiments, the average glucose concentration of the fermentation in the pre-fermenter vessel, propagator vessel, or in any of the fermentation vessels is maintained in a range that is greater than or equal to the glucose concentration associated with glucose repression in a yeast. In some embodiments, the glucose concentration associated with glucose repression in a yeast is in the range of 2 to 5 g/L. Accordingly, in such embodiments, the average glucose concentration of the fermentation medium in the pre-fermenter vessel or in any of the fermentation vessels can be maintained at a level greater than or equal to 2, 3, 4, or 5 g/L.

Other fermentation conditions can be adjusted and/or maintained in the continuous fermentation process, including, but not limited to: temperature, pH, volumetric or specific oxygen uptake rate (OUR), or the concentration of any carbon source or any fermentation medium nutrient. In some embodiments, the temperature in the pre-fermenter vessel, propagator vessel, or in any other fermentation vessel can be in the range of 20-45, 20-40, 20-30, 25-35, or 30-40° C. In some embodiments, the pH in the pre-fermenter vessel, propagator vessel, or in any other fermentation vessel can be in the range of 2 to 7, 3 to 6, 4.5 to 5.5, or 3.5 to 4.5.

In some embodiments, the cell density in the pre-fermenter vessel is in the range of 3 to 10 g/L or 5 to 10 g/L. In some embodiments, the cell density in the propagator vessel is in the range of 10 to 50 g/L In one aspect, the process uses the yeasts described herein that consume glucose generated from trehalose via catalysis using trehalase during the fermentation process. In some embodiments, the total trehalose content in the sum of all output streams is less than 90% of the trehalose added to or generated during fermentation process. In some embodiments, the total trehalose content in the output of the fermentation process is less than 99%, 95%, 85%, 80%, 75%, 70%, 65%, 60%, 55%, 50%, 45%, 40%, 35%, 30%, 25%, 20%, 15%, or 10% of the trehalose generated during the fermentation process. In some embodiments, the trehalose content in the sum of all output streams of the fermentation process is less than 10, 9, 8, 7, 6, 5, 4, 3, 2, 1, 0.5, or 0.1 g/L.

The continuous fermentation processes described herein can produce ethanol or another bioproduct at commercially significant rates. In some embodiments, the processes can produce the bioproduct at a rate of at least 0.5, 1.0, 1.5, 2.0, 2.5, 3.0, or 3.2 g $L^{-1}$ $h^{-1}$.

EXPERIMENTAL EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather should be construed to encompass any and all variations which become evident as a result of the teaching provided herein. This disclosure is generally directed to embodiments of S. cerevisiae yeasts producing ethanol. However, the disclosure is not limited to such yeasts and fermentation products. Embodiments directed to other yeast species and/or bioproducts are intended to be included within the teachings and inventions of this disclosure.

Example 1: Genetically Modified Yeast Strains Expressing Trehalases

In this example, *Saccharomyces cerevisiae* strains are transformed to express acid trehalases from *Kluyveromyces lactis*, *Candida parapsilosis*, and *Candida glabrata*. The acid trehalases are expressed using the TDH3 promoter. A version of each trehalase is synthesized with that gene's native signal peptide, and a second version of each is synthesized with the MFα2 signal peptide from S. cerevisiase. *Saccharomyces cerevisiae* strains are also transformed to express a trehalase from *Magnaporthe grisea* expressed using the SAM2 promoter. Selected strains are also transformed to include glucoamylase expression and/or genes associated with glycerol reduction. The transformed strains are used in ethanol-producing fermentations. The transformed strains consume trehalose formed during fermentation, and transformed strains are shown to produce higher quantities of ethanol compared to a strain that does not express a heterologous trehalase.

Strain Construction

Strain 1

Strain 1-3, described in International Patent Application Publication No. WO 2016/160584, filed 25 Mar. 2016, is a *Saccharomyces cerevisiae* strain (Strain 14883, a version of Ethanol Red™ *Saccharomyces cerevisiae*) in which both copies of the ScURA3 gene are deleted. For the purposes of this disclosure, strain 1-3 is referred to as Strain 1.

Strain 2

Strain 1 is transformed with SEQ ID NO: 6. SEQ ID NO: 6 contains: i) an empty expression cassette containing the ScTDH3 promoter; ii) a ScURA3 expression cassette; iii) the *Saccharomyces cerevisiae* CEN6 centromere for stable replication; and iv) a beta-lactamase expression cassette. Transformants are selected on ScD-Uracil plates. Resulting transformants are streaked for single colony isolation on ScD-Uracil plates. A single colony is selected. Correct integration of SEQ ID NO: 6 into the selected colony is verified by PCR. A PCR verified isolate is designated as Strain 2.

Strain 3

Strain 1 is transformed with SEQ ID NO: 7. SEQ ID NO: 7 contains: i) an expression cassette for a trehalase from *K. lactis* with the MFα2 secretion signal encoding the amino acid sequence SEQ ID NO: 8 expressed by the TDH3 promoter; ii) a ScURA3 expression cassette; iii) the *Saccharomyces cerevisiae* CEN6 centromere for stable replication; and iv) a beta-lactamase expression cassette. Transformants are selected on ScD-Uracil plates. Resulting transformants are streaked for single colony isolation on ScD-Uracil plates. A single colony is selected. Correct integration of SEQ ID NO: 7 into the selected colony is verified by PCR. A PCR verified isolate is designated as Strain 3.

Strain 4

Strain 1 is transformed with SEQ ID NO: 9. SEQ ID NO: 9 contains: i) an expression cassette for a trehalase from *K. lactis* encoding the amino acid sequence SEQ ID NO: 1 expressed by the TDH3 promoter; ii) a ScURA3 expression cassette; iii) the *Saccharomyces cerevisiae* CEN6 centromere for stable replication; and iv) a beta-lactamase expression cassette. Transformants are selected on ScD-Uracil plates. Resulting transformants are streaked for single colony isolation on ScD-Uracil plates. A single colony is selected. Correct integration of SEQ ID NO: 9 into the selected colony is verified by PCR. A PCR verified isolate is designated as Strain 4.

Strain 5

Strain 1 is transformed with SEQ ID NO: 10. SEQ ID NO: 10 contains: i) an expression cassette for a trehalase from *C. parapsilosis* with the MFα2 secretion signal encoding the amino acid sequence SEQ ID NO: 11 expressed by the TDH3 promoter; ii) a ScURA3 expression cassette; iii) the *Saccharomyces cerevisiae* CEN6 centromere for stable replication; and iv) a beta-lactamase expression cassette. Transformants are selected on ScD-Uracil plates. Resulting transformants are streaked for single colony isolation on ScD-Uracil plates. A single colony is selected. Correct integration of SEQ ID NO: 10 into the selected colony is verified by PCR. A PCR verified isolate is designated as Strain 5.

Strain 6

Strain 1 is transformed with SEQ ID NO: 12. SEQ ID NO: 12 contains: i) an expression cassette for a trehalase from *C. parapsilosis* encoding the amino acid sequence SEQ ID NO: 2 expressed by the TDH3 promoter; ii) a ScURA3 expression cassette; iii) the *Saccharomyces cerevisiae* CEN6 centromere for stable replication; and iv) a beta-lactamase expression cassette. Transformants are selected on ScD-Uracil plates. Resulting transformants are streaked for single colony isolation on ScD-Uracil plates. A single colony is selected. Correct integration of SEQ ID NO: 12 into the selected colony is verified by PCR. A PCR verified isolate is designated as Strain 6.

Strain 7

Strain 1 is transformed with SEQ ID NO: 13. SEQ ID NO: 13 contains: i) an expression cassette for a trehalase from *C. glabrata* with the MFα2 secretion signal encoding the amino acid sequence SEQ ID NO: 14 expressed by the TDH3 promoter; ii) a ScURA3 expression cassette; iii) the *Saccharomyces cerevisiae* CEN6 centromere for stable replication; and iv) a beta-lactamase expression cassette. Transformants are selected on ScD-Uracil plates. Resulting transformants are streaked for single colony isolation on ScD-Uracil plates. A single colony is selected. Correct integration of SEQ ID NO: 13 into the selected colony is verified by PCR. A PCR verified isolate is designated as Strain 7.

Strain 8

Strain 1 is transformed with SEQ ID NO: 15. SEQ ID NO: 15 contains: i) an expression cassette for a trehalase from *C. glabrata* encoding the amino acid sequence SEQ ID NO: 3 expressed by the TDH3 promoter; ii) a ScURA3 expression cassette; iii) the *Saccharomyces cerevisiae* CEN6 centromere for stable replication; and iv) a beta-lactamase expression cassette. Transformants are selected on ScD-Uracil plates. Resulting transformants are streaked for single colony isolation on ScD-Uracil plates. A single colony is selected. Correct integration of SEQ ID NO: 15 into the selected colony is verified by PCR. A PCR verified isolate is designated as Strain 8.

Strain 9

Strain 1 is co-transformed with SEQ ID NO: 93 and SEQ ID NO: 94. SEQ ID NO: 93 contains the following elements: i) DNA homologous to the 5' region of the native FCY1 gene; and ii) an expression cassette for a unique codon optimized variant of the *Rhizopus microsporus* glucoamylase (SEQ ID NO: 95), under control of the TDH3 promoter and CYC1 terminator; and iii) the URA3 promoter as well as a portion of the URA3 gene. SEQ ID NO: 94 contains the following elements: i) a portion of the URA3 gene and terminator; and ii) DNA homologous to the 3' region of the native FCY1 gene. Transformants were selected on ScD-Ura. Resulting transformants were struck for single colony isolation on ScD-Ura. Single colonies were selected, and the correct integration of the expression cassette is confirmed by PCR. Three independent transformants were tested in a shake flask fermentation and a representative isolate is designated Strain 9.

Strain 10

Strain 9 is co-transformed with SEQ ID NO: 96 and SEQ ID NO: 97. SEQ ID NO: 96 contains the following elements: i) DNA homologous to the 5' region of the native FCY1 gene; and ii) an expression cassette for a unique codon optimized variant of the *Rhizopus microsporus* glucoamylase(SEQ ID NO: 95), under control of the TDH3 promoter and CYC1 terminator; and iii) the TEF1 promoter as well as a portion of the *Aspergillus nidulans* amdS gene. SEQ ID NO: 97 contains the following elements: i) a portion of the *Aspergillus nidulans* acetamidase (amdS) gene and TEF1 terminator; and ii) DNA homologous to the 3' region of the native FCY1 gene. Transformants were selected on YNB+acetamide plates. Resulting transformants were struck for single colony isolation on YNB+acetamide plates. Single colonies were selected, and the correct integration of the expression cassette is confirmed by PCR. Three independent transformants were tested in a shake flask fermentation and a representative isolate is designated Strain 10.

Strain 11

Strain 10 is transformed with SEQ ID NO: 98. Transformants were selected on synthetic complete media containing 3.5 g/L of p-fluorophenylalanine, and 1 g/L L-tyrosine (ScD-PFP). Resulting transformants were struck for single colony isolation on ScD-PFP. A single colony is selected. The PCR verified isolate is designated Strain 11.

Strain 12

Strain 11 is transformed with SEQ ID NO: 99. Transformants were selected on ScD-ura. Resulting transformants were struck for single colony isolate on ScD-ura. A single colony is selected. The PCR verified isolate is designated Strain 12.

Strain 13

Strain 11 is co-transformed with SEQ ID NO: 100 and SEQ ID NO: 101, and SEQ ID NO: 102 and SEQ ID NO: 103. Transformants were selected on YNB+acetamide plates. Resulting transformants were struck for single colony isolation on YNB+acetamide plates. Single colonies were selected, and the correct integration of the expression cassette is confirmed by sequencing. Three independent transformants were tested in a shake flask fermentation and a representative isolate is designated Strain 13.

Strain 14

Strain 13 is transformed with SEQ ID NO: 98. Transformants were selected on synthetic complete media containing 3.5 g/L of p-fluorophenylalanine, and 1 g/L L-tyrosine (ScD-PFP). Resulting transformants were struck for single colony isolation on ScD-PFP. A single colony is selected. The PCR verified isolate is designated Strain 14.

Strain 15

Strain 14 is transformed with SEQ ID NO: 99. Transformants were selected on ScD-ura. Resulting transformants were struck for single colony isolate on ScD-ura. A single colony is selected. The PCR verified isolate is designated Strain 15.

Strain 16

Strain 11 is co-transformed with SEQ ID NO: 93 and SEQ ID NO: 104. SEQ ID NO: 93 contains the following elements: i) DNA homologous to the 5' region of the native FCY1 gene; and ii) an expression cassette for a unique codon optimized variant of the *Rhizopus microsporus* glucoamylase (SEQ ID NO: 95), under control of the TDH3 promoter and CYC1 terminator; and iii) the URA3 promoter as well as a portion of the URA3 gene. SEQ ID NO: 104 contains the following elements: i) a portion of the URA3 gene and terminator; and ii) an expression cassette for a codon optimized variant of the *Magnaporthe grisea* trehalase with the MFα2 secretion signal (SEQ ID NO: 105), under control of the SAM2 promoter (SEQ ID NO: 112) and GAL10 terminator; and iii) DNA homologous to the 3' region of the native FCY1 gene. Transformants were selected on ScD-Ura. Resulting transformants were struck for single colony isolation on ScD-Ura. Single colonies were selected, and the correct integration of the expression cassette is confirmed by PCR. Three independent transformants were tested in a shake flask fermentation and a representative isolate is designated Strain 16.

Strain 17

Strain 16 is co-transformed with SEQ ID NO: 96 and SEQ ID NO: 105. SEQ ID NO: 96 contains the following elements: i) DNA homologous to the 5' region of the native FCY1 gene; and ii) an expression cassette for a unique codon optimized variant of the *Rhizopus microsporus* glucoamylase (SEQ ID NO: 95), under control of the TDH3 promoter and CYC1 terminator; and iii) the TEF1 promoter as well as a portion of the *Aspergillus nidulans* amdS gene. SEQ ID NO: 105 contains the following elements: i) a portion of the *Aspergillus nidulans* acetamidase (amdS) gene and ADH1 terminator; and ii) an expression cassette for a codon optimized variant of the *Magnaporthe grisea* trehalase with the MFα2 secretion signal (SEQ ID NO: 105), under control of the SAM2 promoter (SEQ ID NO: 112) and GAL10 terminator; and iii) DNA homologous to the 3' region of the native FCY1 gene. Transformants were selected on YNB+acetamide plates. Resulting transformants were struck for single colony isolation on YNB+acetamide plates. Single colonies were selected, and the correct integration of the expression cassette is confirmed by PCR.

Three independent transformants were tested in a shake flask fermentation and a representative isolate is designated Strain 17.

Strain 18

Strain 17 is transformed with SEQ ID NO: 98. Transformants were selected on synthetic complete media containing 3.5 g/L of p-fluorophenylalanine, and 1 g/L L-tyrosine (ScD-PFP). Resulting transformants were struck for single colony isolation on ScD-PFP. A single colony is selected. The PCR verified isolate is designated Strain 18.

Strain 19

Strain 18 is transformed with SEQ ID NO: 99. Transformants were selected on ScD-ura. Resulting transformants were struck for single colony isolate on ScD-ura. A single colony is selected. The PCR verified isolate is designated Strain 19.

Strain 20

Strain 11 is co-transformed with SEQ ID NO: 93 and SEQ ID NO: 106. SEQ ID NO: 93 contains the following elements: i) DNA homologous to the 5' region of the native FCY1 gene; and ii) an expression cassette for a unique codon optimized variant of the *Rhizopus microsporus* glucoamylase (SEQ ID NO: 95), under control of the TDH3 promoter and CYC1 terminator; and iii) the URA3 promoter as well as a portion of the URA3 gene. SEQ ID NO: 106 contains the following elements: i) a portion of the URA3 gene and terminator; and ii) an expression cassette for a codon optimized variant of the *Candida glabrata* trehalase with the MFα2 secretion signal (SEQ ID NO: 14), under control of the SAM2 promoter (SEQ ID NO: 112) and GAL10 terminator; and iii) DNA homologous to the 3' region of the native FCY1 gene. Transformants were selected on ScD-Ura. Resulting transformants were struck for single colony isolation on ScD-Ura. Single colonies were selected, and the correct integration of the expression cassette is confirmed by PCR. Three independent transformants were tested in a shake flask fermentation and a representative isolate is designated Strain 20.

Strain 21

Strain 20 is co-transformed with SEQ ID NO: 96 and SEQ ID NO: 107. SEQ ID NO: 96 contains the following elements: i) DNA homologous to the 5' region of the native FCY1 gene; and ii) an expression cassette for a unique codon optimized variant of the *Rhizopus microsporus* glucoamylase (SEQ ID NO: 95), under control of the TDH3 promoter and CYC1 terminator; and iii) the TEF1 promoter as well as a portion of the *Aspergillus nidulans* amdS gene. SEQ ID NO: 107 contains the following elements: i) a portion of the *Aspergillus nidulans* acetamidase (amdS) gene and ADH1 terminator; and ii) an expression cassette for a codon optimized variant of the *Candida glabrata* trehalase with the MFα2 secretion signal (SEQ ID NO: 14), under control of the SAM2 promoter (SEQ ID NO: 112) and GAL10 terminator; and iii) DNA homologous to the 3' region of the native FCY1 gene. Transformants were selected on YNB+acetamide plates. Resulting transformants were struck for single colony isolation on YNB+acetamide plates. Single colonies were selected, and the correct integration of the expression cassette is confirmed by PCR. Three independent transformants were tested in a shake flask fermentation and a representative isolate is designated Strain 21.

Strain 22

Strain 14 is co-transformed with SEQ ID NO: 93 and SEQ ID NO: 104. SEQ ID NO: 93 contains the following elements: i) DNA homologous to the 5' region of the native FCY1 gene; and ii) an expression cassette for a unique codon optimized variant of the *Rhizopus microsporus* glucoamylase (SEQ ID NO: 95), under control of the TDH3 promoter and CYC1 terminator; and iii) the URA3 promoter as well as a portion of the URA3 gene. SEQ ID NO: 104 contains the following elements: i) a portion of the URA3 gene and terminator; and ii) an expression cassette for a codon optimized variant of the *Magnaporthe grisea* trehalase with the MFα2 secretion signal (SEQ ID NO: 92), under control of the SAM2 promoter (SEQ ID NO: 112) and GAL10 terminator; and iii) DNA homologous to the 3' region of the native FCY1 gene. Transformants were selected on ScD-Ura. Resulting transformants were struck for single colony isolation on ScD-Ura. Single colonies were selected, and the correct integration of the expression cassette is confirmed by PCR. Three independent transformants were tested in a shake flask fermentation and a representative isolate is designated Strain 22.

Strain 23

Strain 22 is co-transformed with SEQ ID NO: 96 and SEQ ID NO: 105. SEQ ID NO: 96 contains the following elements: i) DNA homologous to the 5' region of the native FCY1 gene; and ii) an expression cassette for a unique codon optimized variant of the *Rhizopus microsporus* glucoamylase (SEQ ID NO: 95), under control of the TDH3 promoter and CYC1 terminator; and iii) the TEF1 promoter as well as a portion of the *Aspergillus nidulans* amdS gene. SEQ ID NO: 105 contains the following elements: i) a portion of the *Aspergillus nidulans* acetamidase (amdS) gene and ADH1 terminator; and ii) an expression cassette for a codon optimized variant of the *Magnaporthe grisea* trehalase with the MFα2 secretion signal (SEQ ID NO: 92), under control of the SAM2 promoter (SEQ ID NO: 112) and GAL10 terminator; and iii) DNA homologous to the 3' region of the native FCY1 gene. Transformants were selected on YNB+acetamide plates. Resulting transformants were struck for single colony isolation on YNB+acetamide plates. Single colonies were selected, and the correct integration of the expression cassette is confirmed by PCR. Three independent transformants were tested in a shake flask fermentation and a representative isolate is designated Strain 23.

TABLE 1

Description of Strains

| Strain | Parent | Description |
|---|---|---|
| Strain 1 | Strain 24 | ura3Δ |
| Strain 2 | Strain 1 | URA3+ plasmid |
| Strain 3 | Strain 1 | URA3+ MFα2 signal peptide *Kluyveromyces lactis* trehalase plasmid |
| Strain 4 | Strain 1 | URA3+ *Kluyveromyces lactis* trehalase plasmid |
| Strain 5 | Strain 1 | URA3+ MFα2 signal peptide *Candida parapsilosis* trehalase plasmid |
| Strain 6 | Strain 1 | URA3+ *Candida parapsilosis* trehalase plasmid |
| Strain 7 | Strain 1 | URA3+ MFα2 signal peptide *Candida glabrata* trehalase plasmid |

TABLE 1-continued

Description of Strains

| Strain | Parent | Description |
|---|---|---|
| Strain 8 | Strain 1 | URA3+ *Candida glabrata* trehalase plasmid |
| Strain 9 | Strain 1 | *Rhizopus microsporus* amyA+; URA3+, |
| Strain 10 | Strain 9 | *Rhizopus microsporus* amyA+; URA3+, amdS+ |
| Strain 11 | Strain 10 | *Rhizopus microsporus* amyA+; ura3– |
| Strain 12 | Strain 11 | *Rhizopus microsporus* amyA+; URA3+ |
| Strain 13 | Strain 11 | *Rhizopus microsporus* amyA+; *Bacillus cereus* gapN at GPP1 locus; URA3+, amdS+ |
| Strain 14 | Strain 13 | *Rhizopus microsporus* amyA+; *Bacillus cereus* gapN at GPP1 locus; ura3– |
| Strain 15 | Strain 14 | *Rhizopus microsporus* amyA+; *Bacillus cereus* gapN at GPP1 locus; URA3+ |
| Strain 16 | Strain 11 | *Rhizopus microsporus* amyA+; *Magnaporthe grisea* trehalase; URA3+ |
| Strain 17 | Strain 16 | *Rhizopus microsporus* amyA+; *Magnaporthe grisea* trehalase; URA3+, amds+ |
| Strain 18 | Strain 17 | *Rhizopus microsporus* amyA+; *Magnaporthe grisea* trehalase; ura3– |
| Strain 19 | Strain 18 | *Rhizopus microsporus* amyA+; *Magnaporthe grisea* trehalase; URA3+ |
| Strain 20 | Strain 11 | *Rhizopus microsporus* amyA+; *Candida glabrata* trehalase; URA3+ |
| Strain 21 | Strain 20 | *Rhizopus microsporus* amyA+; *Candida glabrata* trehalase; URA3+, amds+ |
| Strain 22 | Strain 14 | *Rhizopus microsporus* amyA+; *Bacillus cereus* gapN at GPP1 locus; *Magnaporthe grisea* trehalase; URA3+ |
| Strain 23 | Strain 22 | *Rhizopus microsporus* amyA+; *Bacillus cereus*gapN at GPP1 locus; *Magnaporthe grisea* trehalase; URA3+, amds+ |
| Strain 24 | N/A | *Saccharomyces cerevisiae* (Lasaffre, Ethanol Red ™) |

Example 2: Characterization of Strains in Shake Flask Assay

Shake Flask Method

Strains 2 thru 8 are struck to a ScD-Ura plate and incubated at 30° C. until single colonies are visible (1-2 days). Cells from the ScD-Ura plate are scraped into sterile shake flask medium and the optical density (OD600) is measured. Optical density is measured at wavelength of 600 nm with a 1 cm path length using a model Genesys20 spectrophotometer (Thermo Scientific). A shake flask is inoculated with the cell slurry to reach an initial OD600 of 0.1-0.3 Immediately prior to inoculating, 50 mL of shake flask medium is added to a 250 mL non-baffled shake flask (Corning 4995-250) fitted with a screw cap containing a gas-permeable seal (corning 1395-45LTMC). The shake flask medium consists of 725 g partially hydrolyzed corn starch, 150 g filtered light steep water, 50 g water, 25 g glucose, and 1 g urea. Duplicate flasks for each strain are incubated at 30° C. and 80% humidity with shaking in an orbital shaker at 100 rpm for 48 hours. Samples are taken and analyzed for ethanol and trehalose concentrations in the broth during fermentation by high performance liquid chromatography (HPLC).

Results

In each Figure, the control strain is strain 2; strains containing the heterologous trehalase from *K. lactis* are strains 3 and 4; strains containing the heterologous trehalase from *C. parapsilosis* are strains 5 and 6; and strains containing the heterologous trehalase from *C. glabrata* are strains 7 and 8.

FIG. 1 shows that in a fermentation without added trehalose, strains containing the heterologous trehalase from *C. parapsilosis* consume significantly more of the trehalose that is produced during a fermentation than the control strain.

Figure 2:
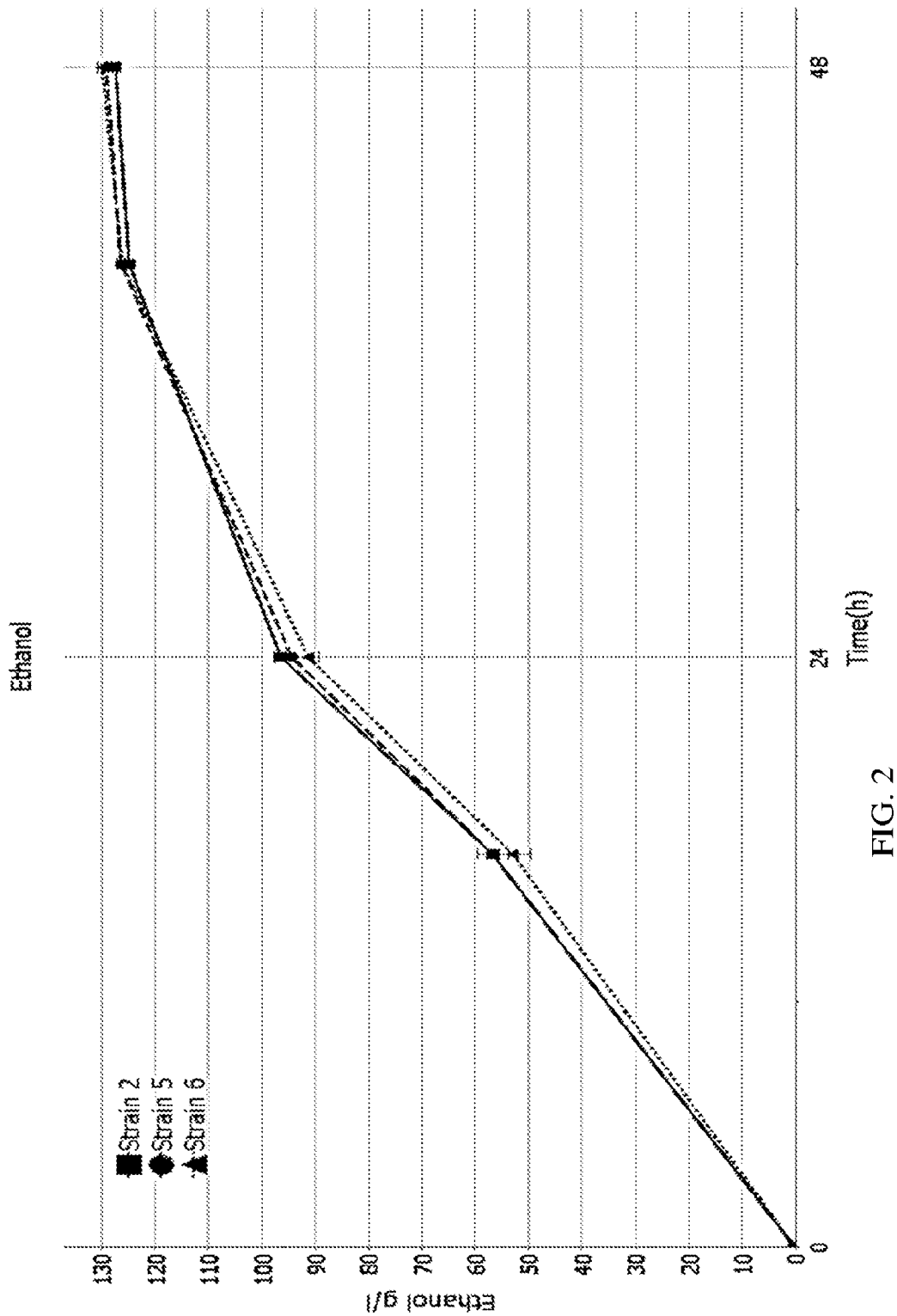
FIGS. 2 and 3 are graphs showing ethanol amounts in a fermentation without added trehalose.
Figure 3:
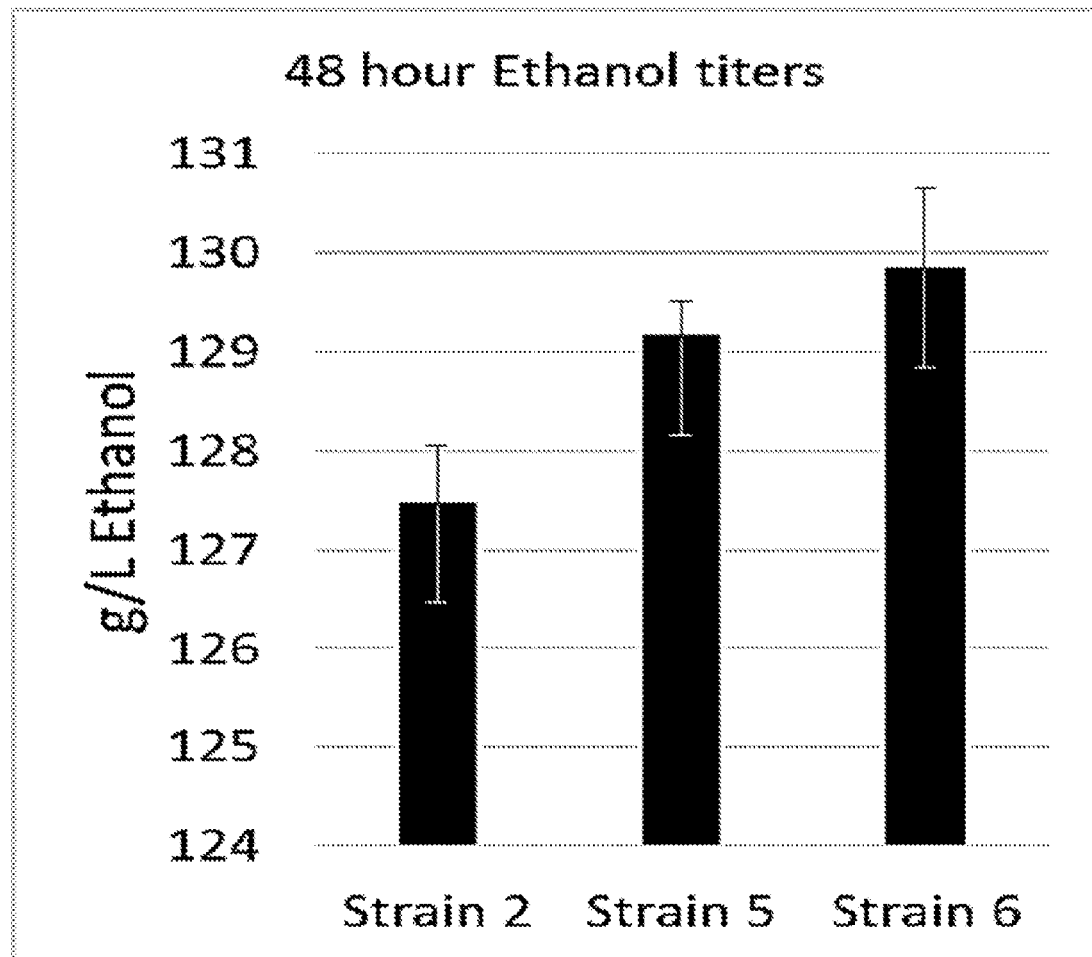

FIGS. 2 and 3 show that in a fermentation without added trehalose, strains containing the heterologous trehalase from *C. parapsilosis* produce significantly more ethanol than the control strain.

Figure 4:
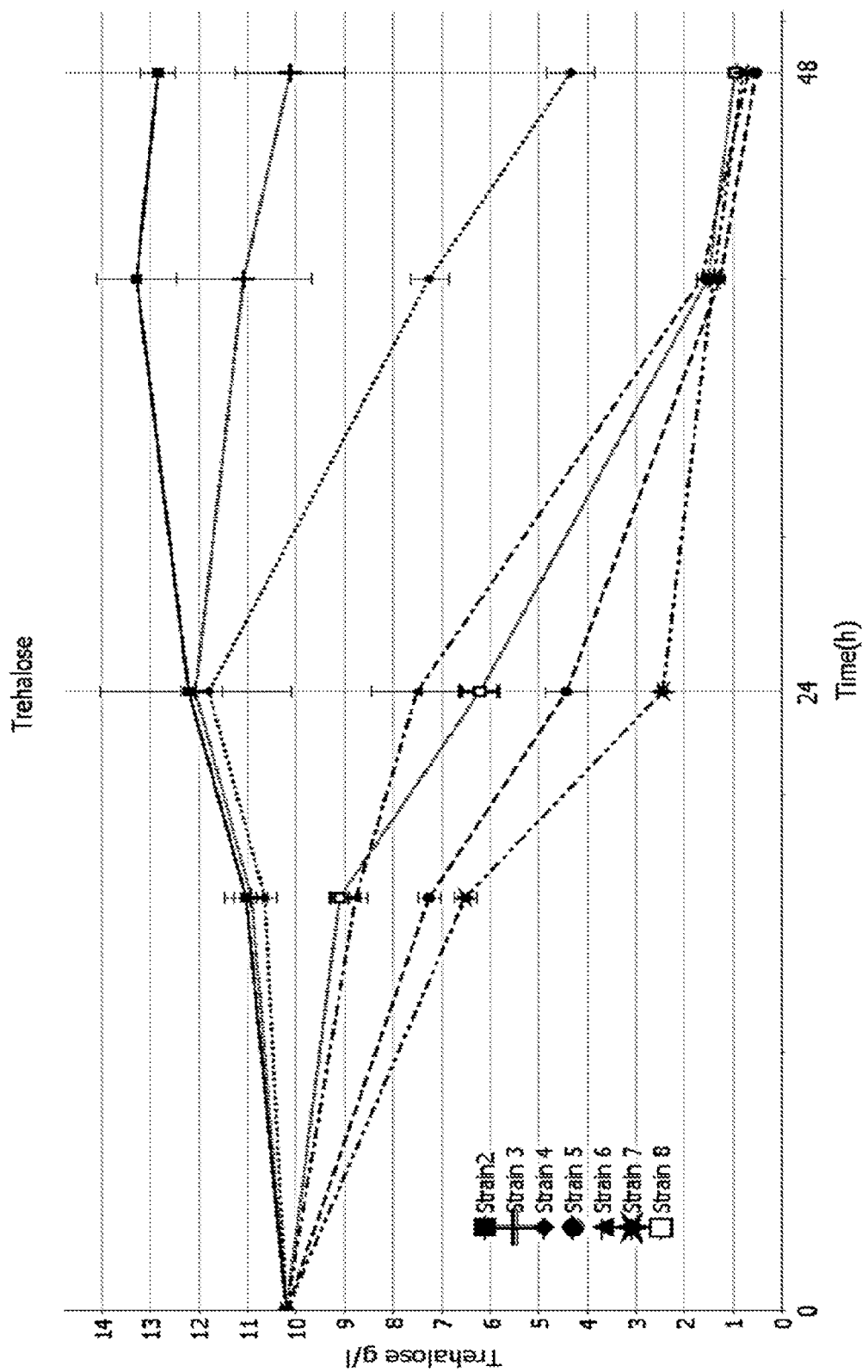
FIG. 4 is a graph showing trehalose concentration over time in fermentations with added trehalose.

FIG. 4 shows that in a fermentation with 10 g/L trehalose added prior to the start, strains containing the heterologous trehalase from *K. lactis* (3&4), *C. parapsilosis* (5&6) and *C. glabrata* (7&8) consume significantly more of the trehalose than the control strain (2). Also, all 3 heterologous trehalases utilizing the MFα2 signal peptide hydrolyze trehalose at a faster rate than the same gene utilizing the respective gene's native signal peptide. The strains containing the *C. parapsilosis* and *C. glabrata* heterologous trehalases all reach final trehalose titers of −1 g/L resulting in similar 48 hour ethanol titers shown in FIGS. 5 and 6.

Figure 5:
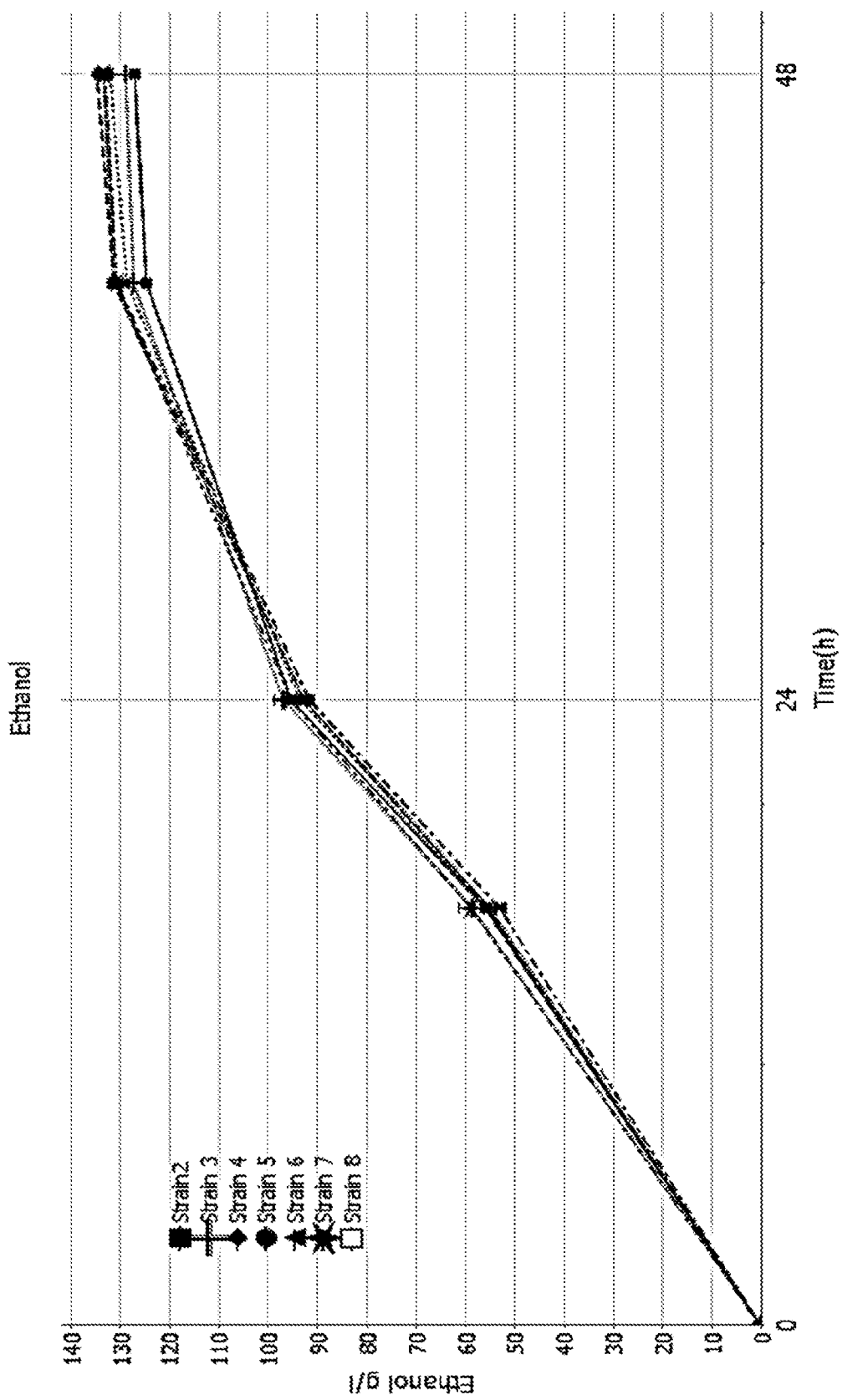
FIGS. 5 and 6 are graphs showing ethanol amounts in a fermentation with added trehalose.
Figure 6:
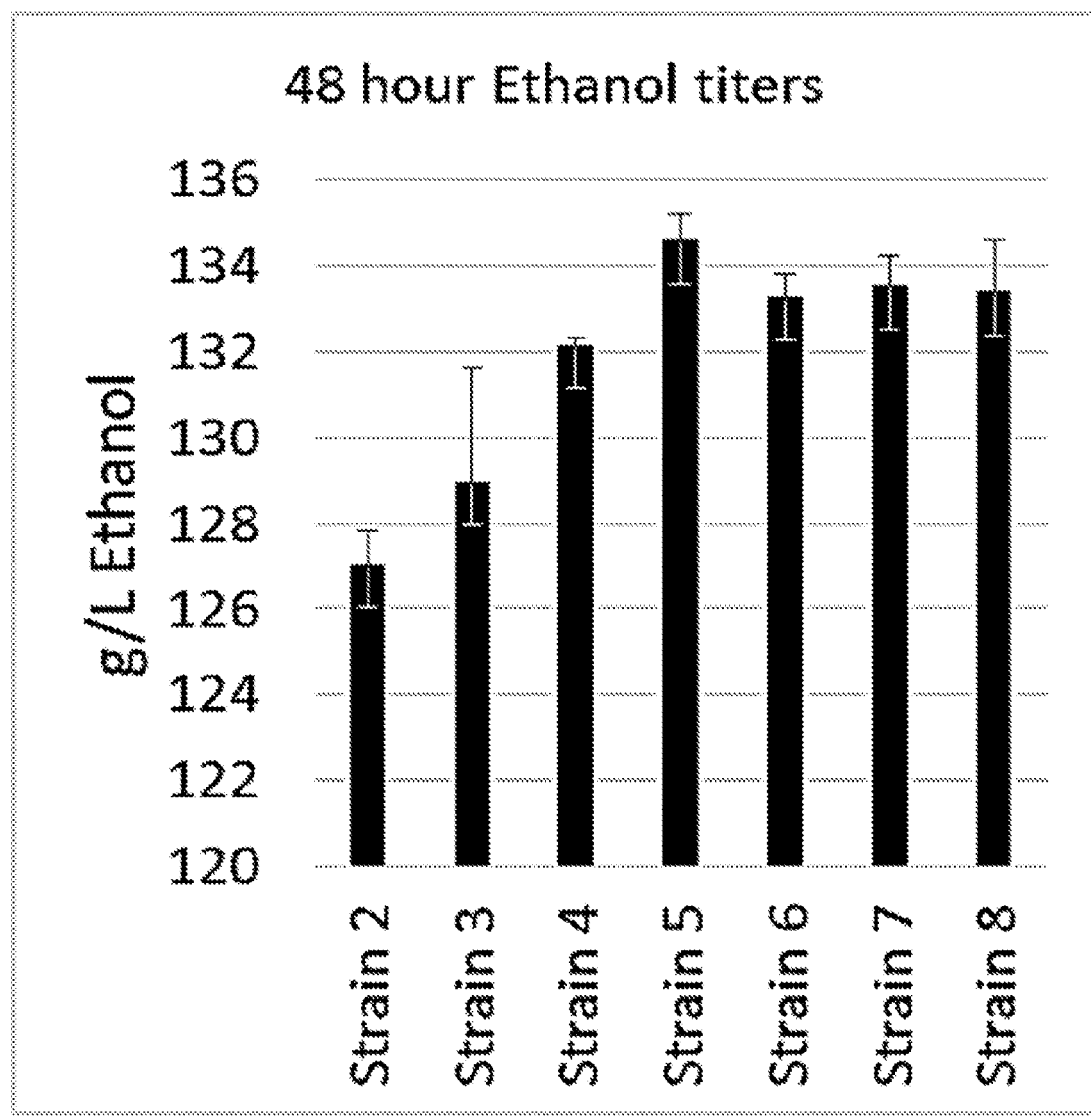

FIGS. 5 and 6 show that in a fermentation with 10 g/L trehalose added prior to the start, strains containing the heterologous trehalase from *K. lactis, C. parapsilosis* and *C. glabrata* produce significantly more ethanol than the control strain. The strains containing the *C. parapsilosis* and *C. glabrata* heterologous trehalases produce significantly more ethanol than the strains containing the *K. lactis* trehalase.

Figure 7:
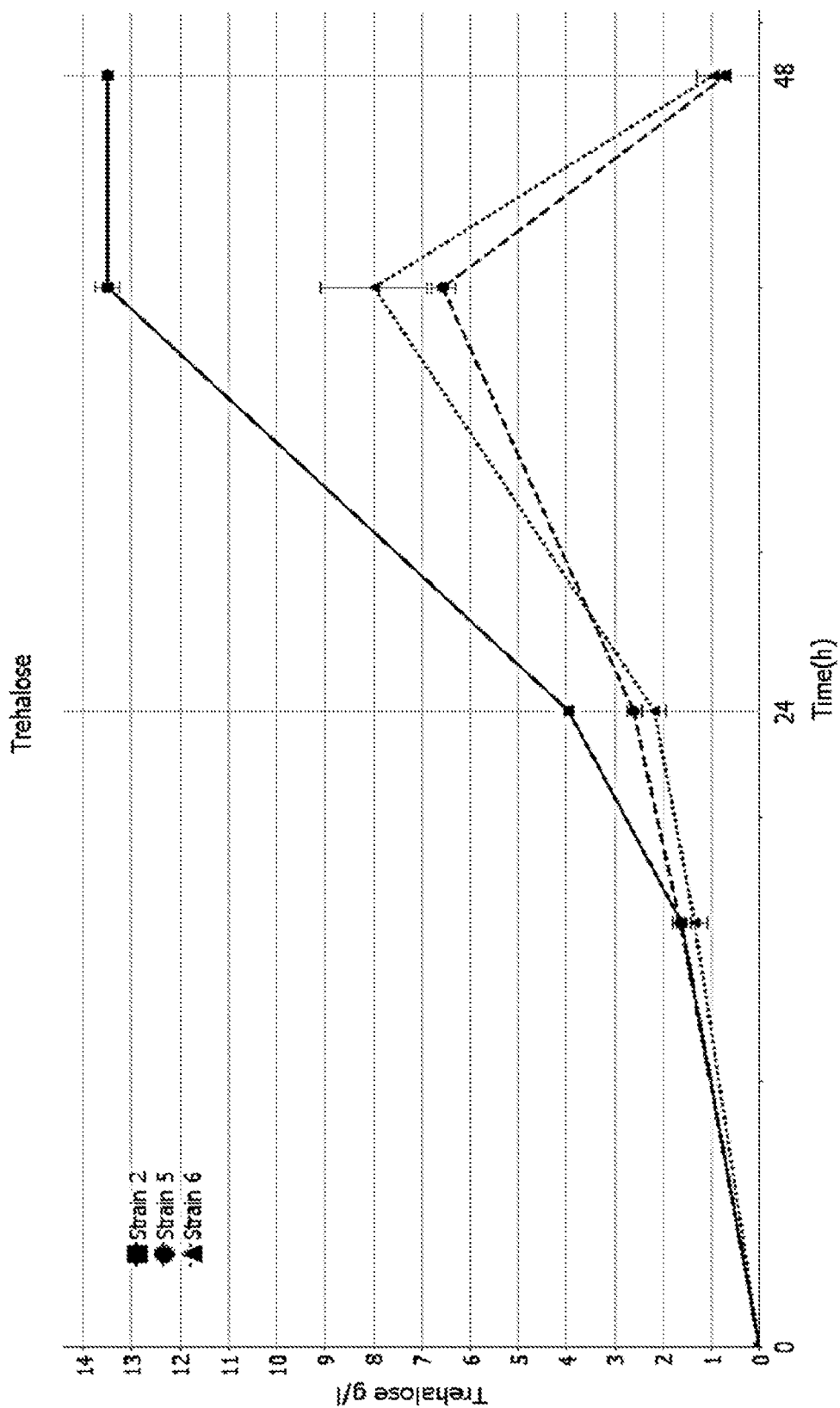
FIG. 7 is a graph showing trehalose concentration over time in fermentations with added trehalose.

FIG. 7 shows that in a fermentation with 10 g/L trehalose added to the fermentation immediately prior to sampling at 40 hours, strains containing the heterologous trehalase from *C. parapsilosis* consume significantly more of the trehalose than the control strain. The data shows that the trehalase is still significantly active later during fermentation.

Figure 8:
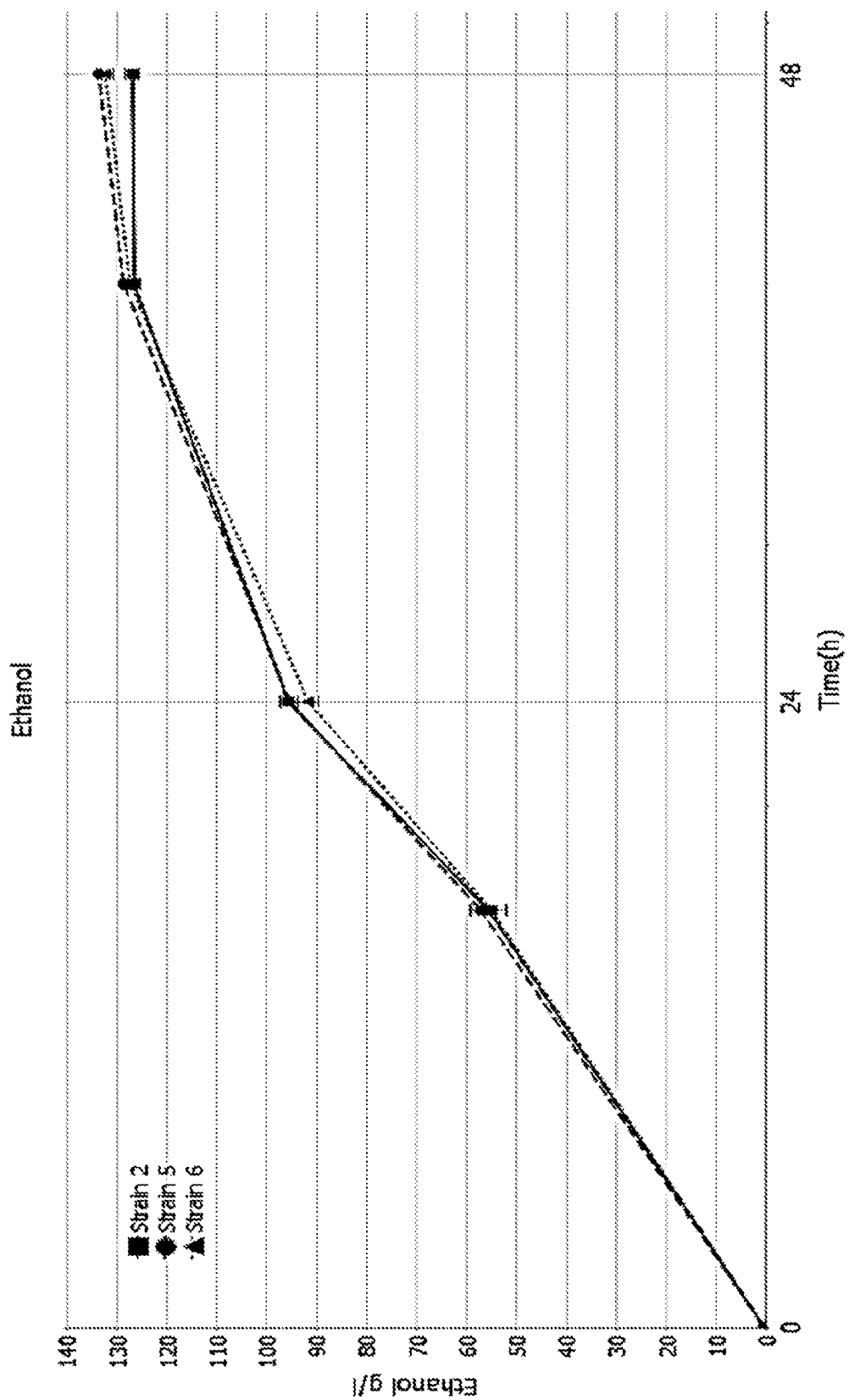
FIGS. 8 and 9 are graphs showing ethanol amounts in a fermentation with added trehalose.
Figure 9:
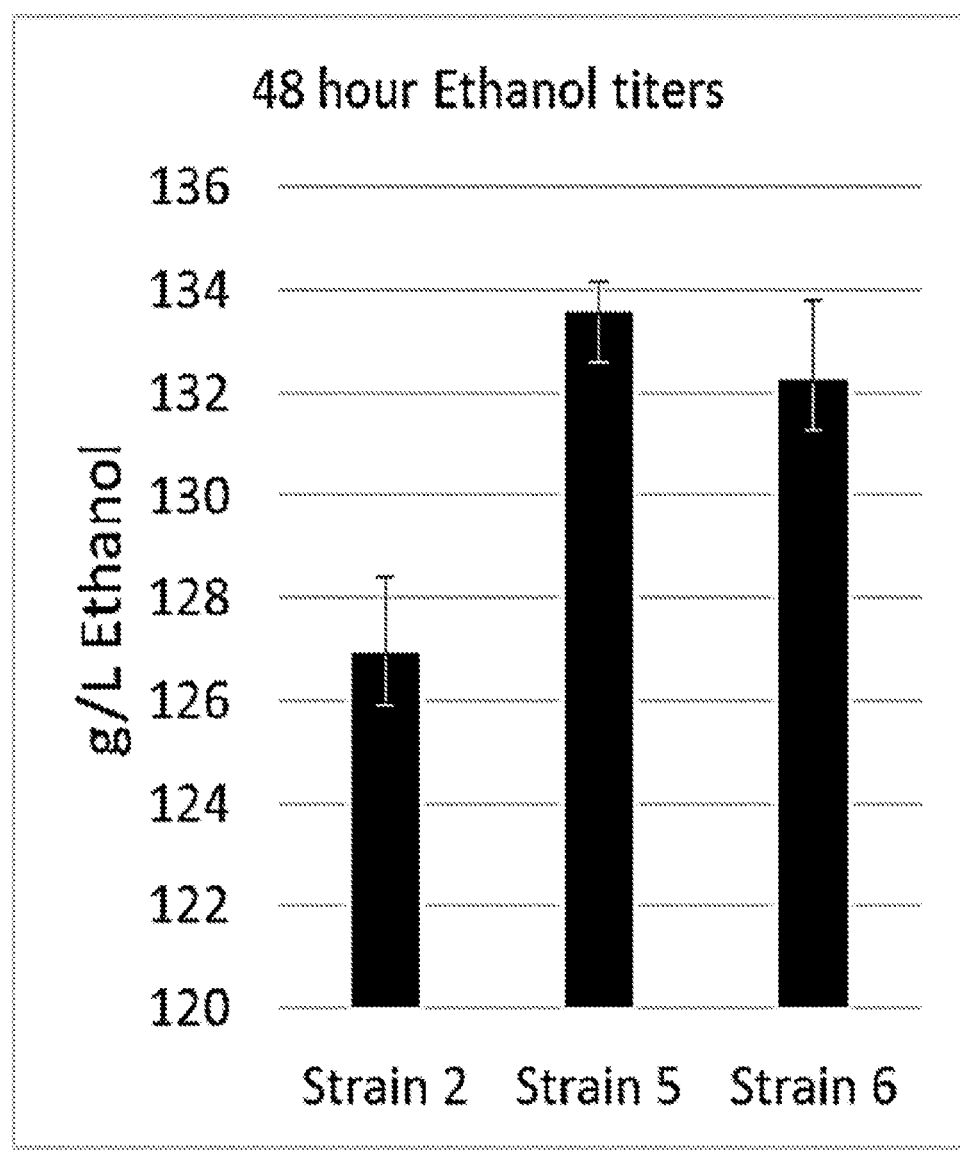

FIGS. 8 and 9 show that in a fermentation with 10 g/L trehalose added to the fermentation immediately prior to sampling at 40 hours, strains containing the heterologous trehalase from *C. parapsilosis* produce significantly more ethanol than the control strain.

Example 3: Characterization of Strains in 32% DS Corn Mash at 33.3° C.

Strains 12, 15, 19, 21, 23, and 24 are struck to a YPD plate and incubated at 30° C. until single colonies are visible (1-2 days). Cells from the YPD plate are scraped into pH 7.0 phosphate buffer and the optical density ($OD_{600}$) is measured. Optical density is measured at wavelength of 600 nm with a 1 cm path length using a model Genesys20 spectrophotometer (Thermo Scientific). A shake flask is inoculated with the cell slurry to reach an initial $OD_{600}$ of 0.1. Immediately prior to inoculating the following materials are added to each flask: 50 grams of liquified corn mash is added to a 250 mL baffled shake flask sealed with air-lock containing 4 ml of sterilized canola oil, 190 ul of 500 g/L filter-sterilized urea, and 2.5 ul of 100 mg/ml of filter sterilized ampicillin 0.284 AGU/g DS (70 µl of a 1:2 dilution) of glucoamylase (Amyloglucosidase from *Aspergillus niger*, Sigma) is added to flasks containing the control Strain 24, and 0.114 AGU/g DS (28 µl of a 1:2 dilution) of glucoamylase (Amyloglucosidase from *Aspergillus niger*, Sigma) is added to the remaining flasks. Amyloglucosidase from *Aspergillus niger*, Sigma (catalog #A7095) is estimated to have approximately 260 AGU/ml of aqueous enzyme solution. Duplicate flasks for each strain are incubated at 33.3° C. with shaking in an orbital shake at 100 rpm for approximately 48 hours. At 48 hours, 1 ml samples are taken and analyzed for ethanol and trehalose concentrations in the broth by high performance liquid chromatography.

Figure 10:
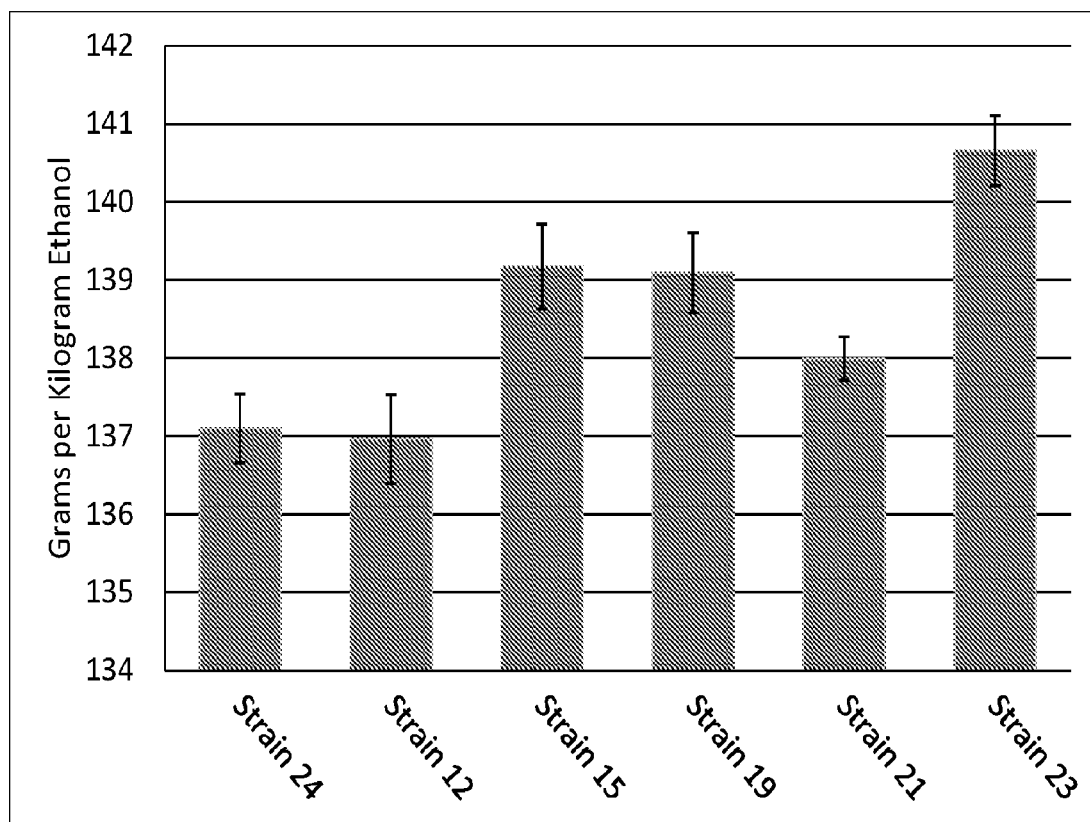
FIG. 10 is a graph showing ethanol amounts in a corn mash fermentation using different yeast strains.
Figure 11:
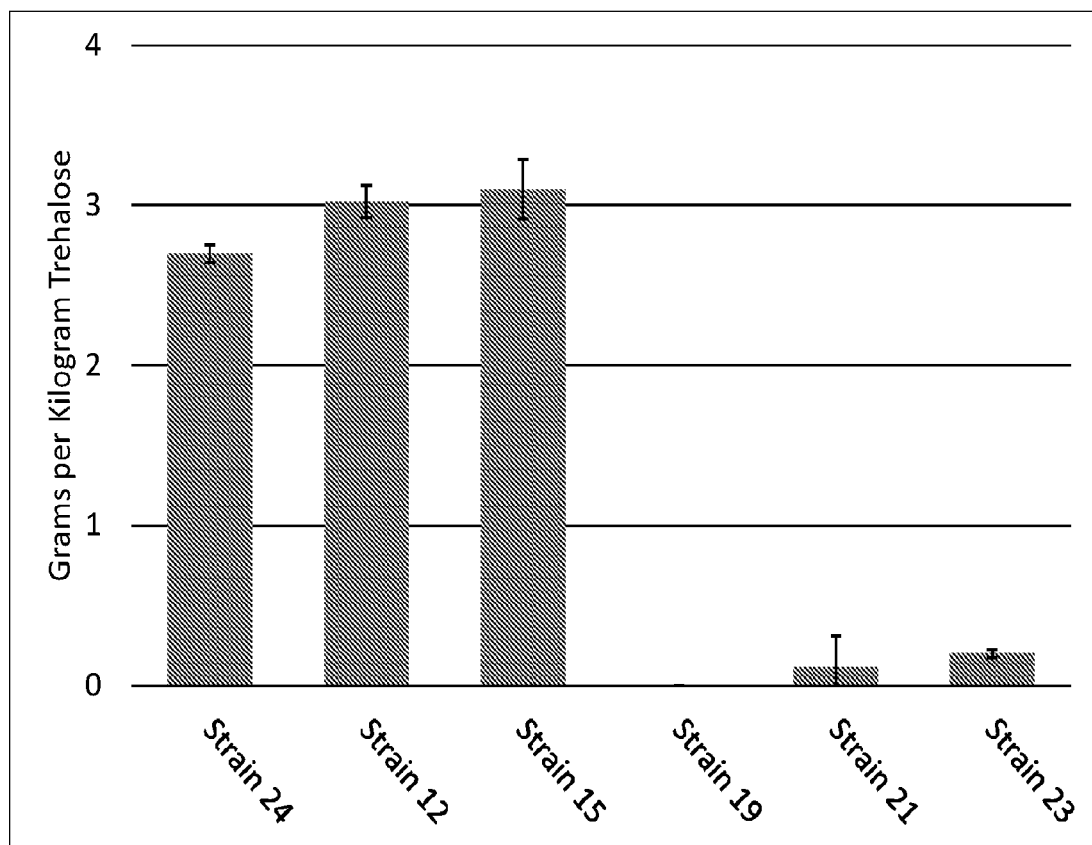
FIG. 11 is a graph showing trehalose amounts in a corn mash fermentation using different yeast strains.

FIGS. 10 and 11 show results for selected strains in a corn mash fermentation. Strains containing a heterologous trehalase (strains 19, 21, and 23) and also the *Rhizopus microsporus* GA (Rmic GA) show significantly higher ethanol production and significantly lower trehalose present at the end of fermentation compared to a wild type strain (strain 24) or a strain having the Rmic GA without a heterologous trehalase (strain 12). Strain 15 (which includes both the Rmic GA and a glycerol reduction trait, but no heterologous trehalase) demonstrates an ethanol titer higher than some strains containing a heterologous trehalase. However, the corresponding strain having the same traits as strain 15, but also including the heterologous trehalase (strain 23), demonstrates the highest ethanol titer of all strains tested.

EMBODIMENTS

The following embodiments are provided as non-limiting examples of embodiments. The present application is not limited to only these embodiments.

Embodiment A. A genetically modified yeast comprising a heterologous gene encoding a trehalase (EC 3.2.1.28) polypeptide,
wherein the yeast is capable of producing ethanol when the yeast is present in a fermentation medium comprising trehalose.

B. The yeast of embodiment A, wherein the trehalase polypeptide is an acid trehalase.

C. The yeast of any of embodiments A-B, wherein the gene encoding a trehalase polypeptide is derived from an organism selected from the group consisting of *Magnaporthe grisea, Kluyveromyces lactis, Candida parapsilosis*, and *Candida glabrata*.

D. The yeast of any of embodiments A-C, wherein the trehalase polypeptide encoded by the yeast has a sequence identity of at least 75, 80, 85, 90, 95, or 97% to at least one of the following polypeptide sequences: SEQ ID NO: 1, SEQ ID NO: 2, SEQ ID NO: 3, or SEQ ID NO: 87.

E. The yeast of any of embodiments A-D, wherein the trehalase polypeptide encoded by the yeast comprises a sequence that has a sequence identity of at least 70, 80, 90, or 95% to SEQ ID NO: 83.

F. The yeast of any of embodiments A-E, wherein the trehalase polypeptide encoded by the yeast comprises a sequence that has a sequence identity of at least 70%, at least 75%, at least 80%, at least 85%, at least 90%, at least 94%, or 100% sequence identity to SEQ ID NO: 84 and/or SEQ ID NO: 85.

G. The yeast of any of embodiments A-F, wherein the yeast is a genetically modified *S. cerevisiae*.

H. The yeast of any of embodiments A-G, wherein the trehalase encoded by the yeast comprises a MFα2 signal sequence.

I. The yeast of embodiment H, wherein the MFα2 signal sequence is SEQ ID NO: 4.

J. The yeast of embodiment H, wherein the MFα2 signal sequence has a sequence identity of at least 84%, 89%, or 94% to SEQ ID NO: 4.

K. The yeast of any of embodiments A-J, wherein the trehalase encoded by the yeast has a sequence identity of at least 75, 80, 85, 90, 95, or 97% to at least one of the following polypeptide sequences: SEQ ID NO: 8, SEQ ID NO: 11, SEQ ID NO: 14, or SEQ ID NO: 92.

L. The yeast of any of embodiments A-K, further comprising a heterologous gene encoding a glucoamylase (EC 3.2.1.3) polypeptide.

M. The yeast of embodiment L, wherein the heterologous gene encoding a glucoamylase polypeptide is a glucoamylase gene derived from a species selected from the group consisting of *Amorphotheca resinae, Aspergillus niger, Aspergillus awamori, Aspergillus oryzae, Aspergillus kawachii, Aspergillus shirousami, Blastobotrys adeninivorans, Candida albicans, Rhizopus oryzae, Schizosaccharomyces pombe, Saccharomycopsis fibuligera, Brettanomyces bruxellensis*, and *Cyberlindnera jadinii*.

N. The yeast of embodiment L, wherein the glucoamylase polypeptide encoded by the yeast has a sequence identity of at least 70, 75, 80, 85, 90, or 95% to at least one of the following polypeptide sequences: SEQ ID NO: 16, SEQ ID NO: 17, SEQ ID NO: 18, or SEQ ID NO: 19.

O. The yeast of any of embodiments A-N, further comprising a heterologous gene encoding an isomaltase (EC 3.2.1.10) polypeptide.

P. The yeast of any of embodiments A-O, wherein the yeast encodes for a sugar transporter polypeptide with a sequence identity of at least 70, 80, 90, or 95% to the polypeptide of SEQ ID NO: 20.

Q. The yeast of any of embodiments A-O, wherein the yeast encodes for a sugar transporter polypeptide with a sequence identity of at least 70, 80, 90, or 95% to the polypeptide of SEQ ID NO: 21.

R. The yeast of any of embodiments A-Q, further comprising a heterologous gene encoding a cytochrome b2 (CYB2) (EC 1.1.2.3) polypeptide.

S. The yeast of embodiment R, wherein the CYB2 polypeptide has an amino acid sequence with a sequence identity of at least 50%, 55%, 65%, 70%, 75%, 80%, 85%, 90%, 95%, 97%, or 99% to any one of the following amino acid sequences: SEQ ID NO: 27, SEQ ID NO: 28, SEQ ID NO: 29, SEQ ID NO: 30, SEQ ID NO: 31, SEQ ID NO: 32, or SEQ ID NO: 33.

T. The yeast of embodiment R, wherein the CYB2 polypeptide comprises one or more of the following residues at the indicated positions in SEQ ID NO: 27, SEQ ID NO: 28, SEQ ID NO: 29, SEQ ID NO: 30, SEQ ID NO: 31, SEQ ID NO: 32, or SEQ ID NO: 33: Lys349, Tyr143, Tyr254, and His373.

U. The yeast of any of embodiments A-T, further comprising a heterologous gene encoding a D-lactate dehydrogenase (DLD) (EC 1.1.2.4) polypeptide.

V. The yeast of embodiment U, wherein the encoded DLD polypeptide has an amino acid sequence with a sequence identity of at least 50%, 55%, 65%, 70%, 75%, 80%, 85%, 90%, 95%, 97%, or 99% to any one of the following amino acid sequences: SEQ ID NO: 34, SEQ ID NO: 35, SEQ ID NO: 36, SEQ ID NO: 37, SEQ ID NO: 38, SEQ ID NO: 39, SEQ ID NO: 40, or SEQ ID NO: 41.

W. The yeast of any of embodiment A-V, further comprising a heterologous gene encoding a monocarboxylic/monocarboxylate transporter polypeptide.

X. The yeast of embodiment W, wherein the monocarboxylic/monocarboxylate transporter polypeptide encoded by the yeast has an amino acid sequence with a sequence identity of at least 50%, 55%, 65%, 70%, 75%, 80%, 85%, 90%, 95%, 97%, or 99% to any one of the following amino acid sequence: SEQ ID NO: 22, SEQ ID NO: 23, SEQ ID NO: 24, SEQ ID NO: 25, or SEQ ID NO: 26.

Y. The yeast of any of embodiments A-X, wherein the yeast secretes trehalase in an amount sufficient to reduce the trehalose content of a fermentation broth to less than 0.5 g/L, 1 g/L, 2 g/L, 3 g/L, 4 g/L, 5 g/L, 6 g/L, 7 g/L, 8 g/L, 9 g/L, or 10 g/L when the ethanol titer is at least 75 g/L.

Z. The yeast of any of embodiments A-Y, wherein the yeast is capable of secreting the trehalase extracellularly.

AA. The yeast of any of embodiments A-Z, wherein the trehalase polypeptide encoded by the yeast comprises a sequence that has a sequence identity of at least 76%, at least 84%, at least 92%, or 100% sequence identity to SEQ ID NO: 86.

BB. The yeast of any of embodiments A-AA, wherein the yeast is capable of producing ethanol at a titer of 80 g/L, 90 g/L, 100 g/L, 110 g/L, 120 g/L, 125 g/L, 130 g/L, 135 g/L or greater.

CC. A process for manufacturing ethanol comprising:
fermenting a medium using a genetically modified yeast, wherein the yeast comprises a heterologous trehalase gene,
wherein the ethanol titer at the end of fermentation is at least 90 g/L.

DD. The process of embodiment CC, wherein the fermentation temperature is in the range of 25 to 45° C., 25 to 40° C., 25 to 35° C., 30 to 40° C., or 28 to 38° C.

EE. The process of any of embodiments CC-DD, wherein the ethanol titer at the end of fermentation is at least 80, 90, 100, 110, 120, 130, 135, 140, 145, 150, 155, or 160 g/liter.

FF. The process of any of embodiments CC-EE, wherein the yeast is the yeast of any of embodiments A-BB.

GG. The yeast or process of any of embodiments A-FF, wherein the yeast further comprises a heterologous gene encoding a glucoamylase (EC 3.2.1.3) polypeptide.

HH. The yeast or process of embodiment GG, wherein the glucoamylase polypeptide encoded by the yeast has a sequence identity of at least 70, 75, 80, 85, 90, or 95% to at least one of the following polypeptide sequences: SEQ ID NO: 16 (Sf GA), SEQ ID NO: 17 (Ro GA), SEQ ID NO: 108 (Rmic GA), or SEQ ID NO: 109 (Rdel GA).

II. The yeast or process of any of embodiments A-HH, wherein the yeast comprises a recombinant nucleic acid encoding a glyceraldehyde-3-phosphate dehydrogenase (E.C. 1.2.1.9); and reduced or eliminated expression of a gene encoding a glycerol-3-phosphate phosphatase (E.C. 3.1.3.21).

JJ. The yeast or process of any of embodiments A-HH, wherein the yeast comprises a recombinant nucleic acid encoding a glyceraldehyde-3-phosphate dehydrogenase (GAPN, E.C. 1.2.1.9).

KK. The yeast or process of any of embodiments A-JJ, wherein the recombinant nucleic acid encoding a glyceraldehyde-3-phosphate dehydrogenase (E.C. 1.2.1.9) encodes for a polypeptide having a sequence identify of at least 80%, 85%, 90%, or 95% to SEQ ID NO: 111 (*Bacillus cereus* GAPN).

The disclosures of each and every patent, patent application, or publication cited herein are hereby incorporated by reference in their entirety. While this invention has been disclosed with reference to specific embodiments, other embodiments and variations of this invention may be devised by others skilled in the art without departing from the true spirit and scope of the invention. The appended claims are intended to be construed to include all such embodiments and variations.

SEQUENCE LISTING (112 sequences)

SEQ ID NO: 1 - protein, 1147 aa, Kluyveromyces lactis
MLIVPFILFSVAILAPIYFYLTKPLPLQHTHFGSFVCAEDTLFCPESQRKASEKMYSLLKDHENTFYDEEQQILGNLLLSENTFSRQPYVANGYIGSRIPNLGFGYALDTINVWVNDSSIPGALDNGWPLRNQRFAGAFISDFYCLQEKLNSTNFPELDDDGYSTVISTIPQWTDLSILKHTTTGQIEYINPTDVKLDKITNYMQNLSLQDGIVTTTFVYDKQLLVTTKVVAHRKIYPLGVVTLELSLFDNNSDTSADNENEYVELEICDSLNFSTSHRTVLNDYGYDQNNEGIFMVVEPENVPYSNASLFSYFDIPSRDTLTLSKYSDSISQCTTQILKANSTFVAHKYIGIISSEYDNKQPDDNSNGTSNEALKMSNLERATSIVLDNKGNYDSLIQSHKNAWKRIYKDASIEIPSDGLLEMTAKSSIYHLLANTRSHNVSEDRGLPIGVSGLSSDSYGGMVFWDSDLWILPALLPFFPNAARQINNYRNASLHQAKLNAEKYGYDGALYPWTSGRYANCTSTGPCVDYEYHINVDIALSSFAIYMNGDEDDERSEEYLRYTTWPFVENAAKMFAQYVKWNDTMQQYTTHNLTDPDEYANFVDNAAFTNAGIQSVMVWAHDIARHLGIDPDPQWLEIADNIHIPISETNITLEYSGMNSSVEIKQADVVLMIYPLSYITDQSILNNAIKNLYYYSERQSASGPAMTYPVFVAGAASLLNYGSSSQSYLYKSVVPYLRSPFAQFSEQSDDNFLTNGLTQPAFPFLTANGGFLQSILFGLTGLRYSYEVDEDTGKIHRLLKFNPIQLPLLPGGIRINNFKYMGQVLDVLITDTEGIIIHKNGTKEIRIKVPDRTLIPDVDVKYSEETDPIKQILHGRRSVPTGKNYFTIQPGDVFKTPLYIPKKNLEGNLVEAKQITNLTAGVPGDVAVSVIDGNNFTHWQPAYKNLPARLLIDMGNNFTQEIKSGKIIWGSRPAKTFSLSILPQTEEVFKNLTHILSNVNQYCNKTGDECVRDLERTEKGFDAAIEDVFDWYGIDPDSIISTHPELKDMKTKFVKILDHYKVTPSEPYPWRVYNESQIVLLPGNETDFDIDYSKVAEMNPENVDIDFRGNQTDWRKGRFIVLTVHDTYDDDDDEKGATIKEFALFP

SEQ ID NO: 2 - protein, 1071 aa, Candida parapsilosis
MDIENNGIYMENSSRIKGIRRLFKDNKTYIIAMTIIANFILFYSLHLLNTRFSEAFPFVLPRAEKYTLEQTSDSNLGDFVNSFENKEIFSQVQFSEHAFYDRKMNVVGTIEYSKYNQFQKQPYVANGYIGSRIPNLGHGFTYDQLTESPDSKKDDLYNGWPLFDKRFSGAFIAGFYDLQENTTGNNFPELLKNGYESVISAIPQWTTLKLAIQHGDKRYTLDPASPDGVGQITNYVQNMSLSTGIVTTQFTWLESLDVRYTVLAHRSEINLGLVKVDIKNKGNDTVEIDVIDELNFDTAQRCSLNLIGHDNSGIYVSFSPDNLDYISGAIYSTLHLDSVKRHSKNKKTNQTSSIRLHAQDSTQFGKTVGIVSTDLDPSKFKNSRDTLEFAKKVSQKFEYLDLVIKSHVRAWKELMGKQSTITFPNDPLLDLGSKASVYHLLANTRPDAQGLTGALGVAGLSSDSYGGMVFWDTDFWMFRAILALDPTHAKSIVNYRMHTHQQALKNTPQGYEGAAYPWTSGRFGNCTATGPCLNYEYHINSAIAMAAWELYISGAVDDQYLESTVYPLISDAAKFYADYVTSYNETIDKFITSNLTDPDEYANHVDNGAYTNAGIALLMNWINDIGDILGIKMPEIYTDISQKMYLPTADNSQNITLEYSGMNSSVGIKQADVVLMTYPLQNSLVDDEQAYINMEFYSGKQVSYGPAMTFSIFSIVAANLATSGCASQSYLHKAMQPYLRGPFAQFSEQNNDNFKTNGGTHPAYPFLTAHGGFIQAVVNGLTGLRHSYTIDNGKIRRSLFLDPIALPCLGDGVQYSGIHYDNHTISMNITGSTFVIRNEGKTNKRANDYISITIADRNPGRGTYKLKDNEEKSFKLYQPSKIFEDSVSECGLATFYNITESAPGDSSFSINDGDNTTRWQVKYNDTTGKVLIDLHSIKNITGVVFNWADKPPKKVKLSKYMGTKFKDVTDFLAKVDFGNYVYKNYRFANPGEKLLNQSEVFENVYSDDVTINAPFSSKELEEVIVPVRHNTTSWNINLQGRFLLLEVDGIHNTIPIEDDYGGAKLAEVNFF

SEQ ID NO: 3 - protein, 1212 aa, Candida glabrata
MGFKDKILFWKDEVQYRTLAVADQVANRFFHSFENVYKGDESVEDADSRPVGLTNETLSHSSDFFVLPEERISTRVKIRRQNILNTTLILGMLIALVIWTAILSTNSYFSSSLASASPLFNKEGRVVRPMRESNLGLHADPQTRKSSKTLYDLLSDFDNAFYDDENMILGSLAFGENTYSRQPYVANGYIGSRIPNIGFGYALDTLNLYADAPGALNNGWPLRNRRFAGSFVSDFYSLQAKLNSTNFPELDEKGYTTVISSIPEWTDLQFTVDLNGTNWFNPQSVLIDDVINYNQNLSMKDGIVSTNMDWLNGMINIKSEVWAHRKIHSLGITRLEISLNLDALPDEFTELPVTIYDIIDFNTSHRTTLYEKGQDEDNKAIYMIVNPENVPYSNAVVYSTCTIKGTENNFSPYNFTSDDRIARNYMTNLTEENPKVVIYKYTSVVSSEYNNDEPNPNVNLKFASNIANTAKGNYKSLLSNHKRAWYDLYNDAFIEIPSDSLLEMTARSSLFHLLANTRQYNVSTTRGLPVGVGGLSSDSYGGMVFWDADVWMAPALLPFFPNIAMNMNNYRNATHQQAIENAKQYNYPGAVYPWTSGRYANCTSTGPCIDYEYHINVDIALASFSIYMNGAEGADEDYLRFTTWPMVKDAAVFFKAYVKYNETLGEYETYNLTDPDEFANHVNNGAFTNAGIKTLLKWATDIGTHLGEEVDPKWMEIADNIHIPRSDSNITLEYSGMNSSVEIKQADVTLMVYPLGYINDESILNNAIKDLYYYSERQSASGPAMTYPVFVAAAASLLNHGSSSQSYLYKSVLPYLRSPFAQFSEQSDDNFLTNGLTQPAFPFLTANGGFLQSILFGLTGLRYSYEVTPRTKKISRLLKFDPVKLPLLPGGIAIRNFKYMGQVLDIIIDDNNGTIAHKGGDKPIRIKVPNRDILHDRNITSALYSKRDDDLSATDDYYGTYFTLYPNEELVIPLYDTKLNIDGNIAESKQITNLTAGVPGDVGFSALDGNNYTHWQPFDKSDNAKLLIDLGFNSTHVIKKGIILWGQRPAKNISLSVLPHSERIEQLFANITDLLETSSITKGGSLLNQMLGQTQSNVTAEIDDDILALLNWKGDDLDQLIPYLPDMHLLQEKFIPILKDYPIKPNQRYYKEIIDDDIIKLLPSNTTEFTIDYNSIPGGEKRARYVVLTVHGTYDDDDDLKGATIKEIVLQE

SEQ ID NO: 4 - protein, 19 aa, Saccharomyces cerevisiae
MKFISTFLTFILAAVSVTA

SEQ ID NO: 5 - DNA, 683 bp, Saccharomyces cerevisiae
atctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagttttaaaacactaagaacttagtttcgaataaacacacataaacaaacaaa

SEQ ID NO: 6 - DNA, 5745 bp, Artificial Sequence
  Sequence put together from multiple separate Saccharomyces cerevisiae sequences
tcgagatctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagttttaaaacactaagaacttagtttcgaataaacacacataaacaaacaaatctagattaattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacgcggccgccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccc

SEQ ID NO: 7 - DNA, 9181 bp, Artificial Sequence
  Sequence put together from multiple organisms, K. lactis and S. cerevisiae
gtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagttttaaaacactaagaacttagtttcgaataaacacacataaaaacaaatctagaatgaagttcatttcaactttcttgacttttatcttggctgccgttagtgttactgctaccaaacctttaccattacaacatactcattttggctcttttgtctgcgctgaggataccttattctgccctgaatctcagagaaaagcctctgaaaagatgtatagtttattgaaggatcacgaaaacacattctacgatgaggaacagcaaatcctgggaaacttattgttatcagaaaatacattctcaagacaaccatatgttgcaaacggttacattggatccagaatccctaaccttgggttcggatacgcacttgataccattaacgtttgggtaaatgactcctctataccaggcgcccttgataatggttggccattgagaaaccagagatttgctggggcattcatttcagacttctactgtctacaagagaagctcaactcaactaacttccctgaattggacgatgatggttactcaactgttatatcaacaataccacaatggacagatctctcaattttaaagcacactactacaggtcaaatcgagtacattaatcctacagatgttaagttagataagattacaaactatatgcaaaacttatcacttcaagatggaattgtaacaactacatttgtttacgacaaacaactattggttactacaaaggtagttgcacatagaaagatataccctctcggagtcgttaccttagaactatctttgttcgacaacaattctgatactagtgctgacaacgaaaacgaatacgtcgaattagagatctgtgattcactaaacttctctacatcccacagaaccgtacttaatgattacggttacgatcaaaacaacgagggtattttcatggtggtggagccagaaaacgtcccatattctaatgcatcccttttttcatattttgatatcccaagtagagatacattaacactttctaagtactccgattcaatcagtcaatgtacaacacaaatcttaaaggcaaattcaacttttgtagctcacaagtacatcggtataattagctctgagtacgataacaaacaacctgatgataactctaatggaacttctaatgaagcgcttaaaatgtctaacctggaacgtgcaaccagtattgtgcttgataacaaaggtaattacgattctctgattcaatcacataaaaatgcttggaagagaatttacaaagatgctagcattgaaataccatccgatggtttgctggagatgacagcaaaaagttctatttaccatttactagcaaatacaagatctcataacgtgtctgaggacagaggtttgcctataggcgtgtcaggattatcttctgattcttacgggggtatggttttctgggattctgacttgtggattctaccagcactcctgccattcttcccaaacgctgcaagacagatcaataactacagaaatgcaagccttcaccaggccaagctaaacgcagaaaagtacggctacgatggcgcgctatacccatggacatctggcagatacgcgaactgtacttcaactggtccatgtgtcgactacgaatatcatatcaacgtggacatcgctttgtcatctttcgccatctacatgaatggtgatgaagatgacgaacgttccgaagagtacttgcgttacacaacatggccattcgtagaaaacgcagcaaagatgtttgctcaatacgttaagtggaatgacacaatgcaacaatacaccactcataacttgactgatccagatgaatatgcaaacttcgttgacaacgctgcatttactaatgctggtatacaatctgtgatggtctgggctcatgatatcgccagacacttgggcatcgatccagatccacagtggttggagatagccgacaacatccatattccaatttccgagacaaacatcacattggaatactcaggtatgaactcctctgtcgaaatcaagcaagctgatgtggtattgatgatttacccattatcttacataacagatcaaagcatcttgaacaacgcaattaaaaacttgtactactattctgaacgtcaaagtgcatcagggcctgctatgacatacccagtatttgtcgccggagcggcatctcttcttaactacggttcatcttcacaatcctatctatacaagtcagttgtcccatacttacgtagtccttttgctcaattctcagaacaaagtgacgacaacttcttgaccaatggtctaacacagccagcgttcccatttctaacagctaacggtggtttcttgcagtctattctattcggtttgactgggctcagatacagttacgaagttgatgaagatacagggaaaatccatagattactgaagttcaatccaattcagttgcctctcctacctggaggtattagaattaacaactttaagtacatgggtcaggtattagatgttttgatcacagacaccgagggtatcatcatccacaaaaacggtactaaggaaatcagaatcaaagttccagatagaactctaattcctgatgtagatgtcaagtactcagaagagactgatcctattaagcaaattttgcatggtagaagatctgttccaaccggtaaaaactacttcactatacaacctggtgatgtgttcaagacaccactttacatccctaaaaaaaacttggaaggcaatttggtcgaggctaagcaaattaccaatttgactgccggcgtcccaggtgacgttgctgtctctgtaatagatggaaacaactttacacactggcaaccagcatacaaaaaccttccagccagattgttaatcgatatgggcaataattttacccaagagattaagtccggcaagatcatatggggctcaagaccagcaaaaacattctccctgtcaattttgccacagacagaagaggttttcaaaaatcttacacatattttatctaacgttaatcaatattgtaacaagacaggtgatgagtgcgtcagagatttagagagaacagagaaagggttcgatgccgcaatagaagatgttttcgactggtacggtattgacccagacagcattatctcaacacatcctgaattaaaagatatgaaaacaaagttcgtcaagatcctagatcactacaaagtcactccatccgaaccttatccatggagagtttacaacgagtctcaaatcgtgctgcttccaggcaatgaaacagatttcgatattgattactctaaagttgctgaaatgaaccctgaaaacgttgatattgatttcagagggaaccagacagattggagaaagggaagatttatcgttctcacagtgcatgatacttacgacgacgatgatgacgaaaagggtgccactatcaaggaatttgcattattcccttgattaattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacgcggccgccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctattt

SEQ ID NO: 8 - protein, 1145 aa, Artificial Sequence
  Sequence put together from multiple organisms, K. lactis and S. cerevisiae
MKFISTFLTFILAAVSVTATKPLPLQHTHFGSFVCAEDTLFCPESQRKASEKMYSLLKDHENTFYDEEQQILGNLLLSENTFSRQPYVANGYIGSRIPNLGFGYALDTINVWVNDSSIPGALDNGWPLRNQRFAGAFISDFYCLQEKLNSTNFPELDDDGYSTVISTIPQWTDLSILKHTTTGQIEYINPTDVKLDKITNYMQNLSLQDGIVTTTFVYDKQLLVTTKVVAHRKIYPLGVVTLELSLFDNNSDTSADNENEYVELEICDSLNFSTSHRTVLNDYGYDQNNEGIFMVVEPENVPYSNASLFSYFDIPSRDTLTLSKYSDSISQCTTQILKANSTFVAHKYIGIISSEYDNKQPDDNSNGTSNEALKMSNLERATSIVLDNKGNYDSLIQSHKNAWKRIYKDASIEIPSDGLLEMTAKSSIYHLLANTRSHNVSEDRGLPIGVSGLSSDSYGGMVFWDSDLWILPALLPFFPNAARQINNYRNASLHQAKLNAEKYGYDGALYPWTSGRYANCTSTGPCVDYEYHINVDIALSSFAIYMNGDEDDERSEEYLRYTTWPFVENAAKMFAQYVKWNDTMQQYTTHNLTDPDEYANFVDNAAFTNAGIQSVMVWAHDIARHLGIDPDPQWLEIADNIHIPISETNITLEYSGMNSSVEIKQADVVLMIYPLSYITDQSILNNAIKNLYYYSERQSASGPAMTYPVFVAGAASLLNYGSSSQSYLYKSVVPYLRSPFAQFSEQSDDNFLTNGLTQPAFPFLTANGGFLQSILFGLTGLRYSYEVDEDTGKIHRLLKFNPIQLPLLPGGIRINNFKYMGQVLDVLITDTEGIIIHKNGTKEIRIKVPDRTLIPDVDVKYSEETDPIKQILHGRRSVPTGKNYFTIQPGDVFKTPLYIPKKNLEGNLVEAKQITNLTAGVPGDVAVSVIDGNNFTHWQPAYKNLPARLLIDMGNNFTQEIKSGKIIWGSRPAKTFSLSILPQTEEVFKNLTHILSNVNQYCNKTGDECVRDLERTEKGFDAAIEDVFDWYGIDPDSIISTHPELKDMKTKFVKILDHYKVTPSEPYPWRVYNESQIVLLPGNETDFDIDYSKVAEMNPENVDIDFRGNQTDWRKGRFIVLTVHDTYDDDDDEKGATIKEFALFP

SEQ ID NO: 9 - DNA, 9187 bp, Artificial Sequence
  Sequence put together from multiple organisms, K. lactis and S. cerevisiae
aaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagttttaaaacactaagaacttagtttcgaataaacacacataaaaacaaatctagaatgcttatcgtgccattcattctcttcagcgtagcaattctagctccaatatacttttacttgaccaaacctttaccattacaacatactcattttggctcttttgtctgcgctgaggataccttattctgccctgaatctcagagaaaagcctctgaaaagatgtatagtttattgaaggatcacgaaaacacattctacgatgaggaacagcaaatcctgggaaacttattgttatcagaaaatacattctcaagacaaccatatgttgcaaacggttacattggatccagaatccctaaccttgggttcggatacgcacttgataccattaacgtttgggtaaatgactcctctataccaggcgcccttgataatggttggccattgagaaaccagagatttgctggggcattcatttcagacttctactgtctacaagagaagctcaactcaactaacttccctgaattggacgatgatggttactcaactgttatatcaacaataccacaatggacagatctctcaattttaaagcacactactacaggtcaaatcgagtacattaatcctacagatgttaagttagataagattacaaactatatgcaaaacttatcacttcaagatggaattgtaacaactacatttgtttacgacaaacaactattggttactacaaaggtagttgcacatagaaagatataccctctcggagtcgttaccttagaactatctttgttcgacaacaattctgatactagtgctgacaacgaaaacgaatacgtcgaattagagatctgtgattcactaaacttctctacatcccacagaaccgtacttaatgattacggttacgatcaaaacaacgagggtattttcatggtggtggagccagaaaacgtcccatattctaatgcatcccttttttcatattttgatatcccaagtagagatacattaacactttctaagtactccgattcaatcagtcaatgtacaacacaaatcttaaaggcaaattcaacttttgtagctcacaagtacatcggtataattagctctgagtacgataacaaacaacctgatgataactctaatggaacttctaatgaagcgcttaaaatgtctaacctggaacgtgcaaccagtattgtgcttgataacaaaggtaattacgattctctgattcaatcacataaaaatgcttggaagagaatttacaaagatgctagcattgaaataccatccgatggtttgctggagatgacagcaaaaagttctatttaccatttactagcaaatacaagatctcataacgtgtctgaggacagaggtttgcctataggcgtgtcaggattatcttctgattcttacgggggtatggttttctgggattctgacttgtggattctaccagcactcctgccattcttcccaaacgctgcaagacagatcaataactacagaaatgcaagccttcaccaggccaagctaaacgcagaaaagtacggctacgatggcgcgctatacccatggacatctggcagatacgcgaactgtacttcaactggtccatgtgtcgactacgaatatcatatcaacgtggacatcgctttgtcatctttcgccatctacatgaatggtgatgaagatgacgaacgttccgaagagtacttgcgttacacaacatggccattcgtagaaaacgcagcaaagatgtttgctcaatacgttaagtggaatgacacaatgcaacaatacaccactcataacttgactgatccagatgaatatgcaaacttcgttgacaacgctgcatttactaatgctggtatacaatctgtgatggtctgggctcatgatatcgccagacacttgggcatcgatccagatccacagtggttggagatagccgacaacatccatattccaatttccgagacaaacatcacattggaatactcaggtatgaactcctctgtcgaaatcaagcaagctgatgtggtattgatgatttacccattatcttacataacagatcaaagcatcttgaacaacgcaattaaaaacttgtactactattctgaacgtcaaagtgcatcagggcctgctatgacatacccagtatttgtcgccggagcggcatctcttcttaactacggttcatcttcacaatcctatctatacaagtcagttgtcccatacttacgtagtccttttgctcaattctcagaacaaagtgacgacaacttcttgaccaatggtctaacacagccagcgttcccatttctaacagctaacggtggtttcttgcagtctattctattcggtttgactgggctcagatacagttacgaagttgatgaagatacagggaaaatccatagattactgaagttcaatccaattcagttgcctctcctacctggaggtattagaattaacaactttaagtacatgggtcaggtattagatgttttgatcacagacaccgagggtatcatcatccacaaaaacggtactaaggaaatcagaatcaaagttccagatagaactctaattcctgatgtagatgtcaagtactcagaagagactgatcctattaagcaaattttgcatggtagaagatctgttccaaccggtaaaaactacttcactatacaacctggtgatgtgttcaagacaccactttacatccctaaaaaaaacttggaaggcaatttggtcgaggctaagcaaattaccaatttgactgccggcgtcccaggtgacgttgctgtctctgtaatagatggaaacaactttacacactggcaaccagcatacaaaaaccttccagccagattgttaatcgatatgggcaataattttacccaagagattaagtccggcaagatcatatggggctcaagaccagcaaaaacattctccctgtcaattttgccacagacagaagaggttttcaaaaatcttacacatattttatctaacgttaatcaatattgtaacaagacaggtgatgagtgcgtcagagatttagagagaacagagaaagggttcgatgccgcaatagaagatgttttcgactggtacggtattgacccagacagcattatctcaacacatcctgaattaaaagatatgaaaacaaagttcgtcaagatcctagatcactacaaagtcactccatccgaaccttatccatggagagtttacaacgagtctcaaatcgtgctgcttccaggcaatgaaacagatttcgatattgattactctaaagttgctgaaatgaaccctgaaaacgttgatattgatttcagagggaaccagacagattggagaaagggaagatttatcgttctcacagtgcatgatacttacgacgacgatgatgacgaaaagggtgccactatcaaggaatttgcattattcccttgattaattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacgcggccgccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaat

SEQ ID NO: 10 - DNA, 8866 bp, Artificial Sequence
  Sequence put together from multiple organisms, C. parapsilosis and S. cerevisiae
tgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagttttaaaacactaagaacttagtttcgaataaacacacataaaaacaaatctagaatgaaattcatcagtacctttttaacatttatcttagctgcagtctcagttacagcgagattttctgaggcgttccctttcgtcttgccaagagcagaaaagtacacattggaacaaacatcagattctaacttgggcgatttcgtcaactcattcgagaacaaggagatcttttcacaagttcagttctcagagcatgctttctacgatagaaaaatgaacgtagtggggactattgaatactctaagtacaaccaatttcagaaacaaccatatgtagctaacggttacattggatccagaatcccaaacttgggtcatggtttcacatacgatcaattaactgagtctccagattccaaaaaagatgacttgtataacggctggcctctgttcgataaaagattctcaggtgcctttatcgctggattttacgatttacaggaaaatactaccggaaataacttcccagaacttttaaaaaacggttacgaatccgttattagtgccatccctcaatggactactctcaagctcgcaatccaacacggcgataagagatacactttggaccctgcaagtccagatggtgttggtcaaataactaactacgtccaaaatatgtccttaagcactggcattgttacaacacaatttacatggttagaatcactagatgtaagatatacagtgcttgctcatcgttccgagattaacttgggcctagttaaggtcgatattaaaaacaagggaaatgatacagttgaaattgatgtaatcgatgagttaaacttcgatactgctcagagatgctctctgaatttgatcgggcatgataattctggtatttacgtgtctttctccccagataatctggattacatttctggagctatctacagcacactacacctcgattctgtgaagagacattctaaaaacaaaaagacaaaccagacctcaagcatacgtctgcatgctcaagacagtacacagtttggaaagactgtaggtatagtttcaaccgacctggacccatctaagttcaaaaacagtcgtgacactttggaatttgcaaaaaaagtgtcccaaaagttcgaatacttggacttagttattaagagtcatgtcagagcgtggaaggaactaatgggcaagcaaagtacaataacttttccaaatgatccattgcttgatttgggatctaaggcttcagtttatcacttgctagctaacaccagaccagatgcacaaggcctaactggtgctctcggcgtcgctggcctttcttctgattcatacggtggcatggtgttctgggacaccgatttctggatgttcagagcgatactggccctagatcctacacacgcaaagtcaatagtcaactacagaatgcatacacaccaacaagcactcaaaaacacacctcagggttacgaaggggccgcttacccttggacttctggtcgttttggcaactgcacagccaccgggccttgtttaaattacgaatatcacattaactcagccatagcaatggctgcttgggaattgtacatcagtggagcagtagacgatcaatacttagagagtacagtctacccattgatttcagacgctgcaaagttctacgccgattacgtaacatcatataacgaaactatcgacaagttcattacatcaaacctaaccgacccagatgaatacgctaatcacgtagacaatggtgcctatacaaatgccggtattgcccttcttatgaattggatcaatgacatcggcgacatcctggggattaagatgccagaaatttacactgatatatctcaaaagatgtatctcccaactgcggataattctcaaaacattaccttagaatactctggtatgaactcctctgtcggaatcaaacaagctgatgttgtccttatgacatacccacttcagaactctctagttgacgatgaacaggcatacattaacatggagttttactcaggaaaacaagtttcttacggaccagcaatgaccttctctatattttctattgtcgcagcaaacttggctacatctggttgtgcctcacaatcttacttgcacaaagcaatgcaaccatatcttagaggccctttcgcacaattctccgaacaaaataatgacaacttcaagacaaacggtggaacacatccagcttatccatttcttactgcacatggtgggttcatacaggctgttgtgaacggacttactgggcttagacattcctacacaatcgataatggtaagattcgtagatcactattcttagatcctatcgccttaccttgccttggcgatggggttcaatactccggtattcattacgataatcatacaattagcatgaacattacaggttccaccttcgttatcagaaacgagggcaaaaccaacaagagagcaaacgactatatctctatcactattgccgatagaaatccaggtagaggtacatacaagttgaaggacaatgaagagaaaagcttcaagttataccaaccttctaagatttttgaagattctgtgtcagagtgtggtttggcaactttctacaatataacagaatcagctcctggtgacagctctttctccataaacgatggtgataacactaccagatggcaagttaagtacaatgatacaacaggtaaggtcttgatcgatttgcattcaatcaaaaacatcactggtgttgttttcaactgggctgataagccacctaaaaaggtaaagttgagtaagtacatggggactaagtttaaggatgtcactgactttttggctaaggttgatttcggtaattacgtttacaaaaactacagattcgctaaccctggtgaaaaacttttgaaccaatcagaagtgttcgaaaacgtttactctgatgatgttacaatcaacgcaccattctcttctaaggaactagaggaagttatcgttccagtgagacataatactacatcttggaacattaacttacaaggcagattcttattgttagaagtggacggaatccacaacaccattccaatcgaagatgattacggtggcgcaaagttagccgaagtgaacttcttttagttaattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacgcggccgccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatt

SEQ ID NO: 11 - protein, 1040 aa, Artificial Sequence
  Sequence put together from multiple organisms, C. parapsilosis and S. cerevisiae
MKFISTFLTFILAAVSVTARFSEAFPFVLPRAEKYTLEQTSDSNLGDFVNSFENKEIFSQVQFSEHAFYDRKMNVVGTIEYSKYNQFQKQPYVANGYIGSRIPNLGHGFTYDQLTESPDSKKDDLYNGWPLFDKRFSGAFIAGFYDLQENTTGNNFPELLKNGYESVISAIPQWTTLKLAIQHGDKRYTLDPASPDGVGQITNYVQNMSLSTGIVTTQFTWLESLDVRYTVLAHRSEINLGLVKVDIKNKGNDTVEIDVIDELNFDTAQRCSLNLIGHDNSGIYVSFSPDNLDYISGAIYSTLHLDSVKRHSKNKKTNQTSSIRLHAQDSTQFGKTVGIVSTDLDPSKFKNSRDTLEFAKKVSQKFEYLDLVIKSHVRAWKELMGKQSTITFPNDPLLDLGSKASVYHLLANTRPDAQGLTGALGVAGLSSDSYGGMVFWDTDFWMFRAILALDPTHAKSIVNYRMHTHQQALKNTPQGYEGAAYPWTSGRFGNCTATGPCLNYEYHINSAIAMAAWELYISGAVDDQYLESTVYPLISDAAKFYADYVTSYNETIDKFITSNLTDPDEYANHVDNGAYTNAGIALLMNWINDIGDILGIKMPEIYTDISQKMYLPTADNSQNITLEYSGMNSSVGIKQADVVLMTYPLQNSLVDDEQAYINMEFYSGKQVSYGPAMTFSIFSIVAANLATSGCASQSYLHKAMQPYLRGPFAQFSEQNNDNFKTNGGTHPAYPFLTAHGGFIQAVVNGLTGLRHSYTIDNGKIRRSLFLDPIALPCLGDGVQYSGIHYDNHTISMNITGSTFVIRNEGKTNKRANDYISITIADRNPGRGTYKLKDNEEKSFKLYQPSKIFEDSVSECGLATFYNITESAPGDSSFSINDGDNTTRWQVKYNDTTGKVLIDLHSIKNITGVVFNWADKPPKKVKLSKYMGTKFKDVTDFLAKVDFGNYVYKNYRFANPGEKLLNQSEVFENVYSDDVTINAPFSSKELEEVIVPVRHNTTSWNINLQGRFLLLEVDGIHNTIPIEDDYGGAKLAEVNFF

SEQ ID NO: 12 - DNA, 8959 bp, Artificial Sequence
  Sequence put together from multiple organisms, C. parapsilosis and S. cerevisiae
tgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagttttaaaacactaagaacttagtttcgaataaacacacataaaaacaaatctagaatggacatcgaaaacaatggtatttacatggaaaatagcagtagaatcaagggtatacgtagattattcaaagacaacaagacatatatcattgccatgactatcatagcaaatttcattctgttttactctctacacttacttaataccagattttctgaggcgttccctttcgtcttgccaagagcagaaaagtacacattggaacaaacatcagattctaacttgggcgatttcgtcaactcattcgagaacaaggagatcttttcacaagttcagttctcagagcatgctttctacgatagaaaaatgaacgtagtggggactattgaatactctaagtacaaccaatttcagaaacaaccatatgtagctaacggttacattggatccagaatcccaaacttgggtcatggtttcacatacgatcaattaactgagtctccagattccaaaaaagatgacttgtataacggctggcctctgttcgataaaagattctcaggtgcctttatcgctggattttacgatttacaggaaaatactaccggaaataacttcccagaacttttaaaaaacggttacgaatccgttattagtgccatccctcaatggactactctcaagctcgcaatccaacacggcgataagagatacactttggaccctgcaagtccagatggtgttggtcaaataactaactacgtccaaaatatgtccttaagcactggcattgttacaacacaatttacatggttagaatcactagatgtaagatatacagtgcttgctcatcgttccgagattaacttgggcctagttaaggtcgatattaaaaacaagggaaatgatacagttgaaattgatgtaatcgatgagttaaacttcgatactgctcagagatgctctctgaatttgatcgggcatgataattctggtatttacgtgtctttctccccagataatctggattacatttctggagctatctacagcacactacacctcgattctgtgaagagacattctaaaaacaaaaagacaaaccagacctcaagcatacgtctgcatgctcaagacagtacacagtttggaaagactgtaggtatagtttcaaccgacctggacccatctaagttcaaaaacagtcgtgacactttggaatttgcaaaaaaagtgtcccaaaagttcgaatacttggacttagttattaagagtcatgtcagagcgtggaaggaactaatgggcaagcaaagtacaataacttttccaaatgatccattgcttgatttgggatctaaggcttcagtttatcacttgctagctaacaccagaccagatgcacaaggcctaactggtgctctcggcgtcgctggcctttcttctgattcatacggtggcatggtgttctgggacaccgatttctggatgttcagagcgatactggccctagatcctacacacgcaaagtcaatagtcaactacagaatgcatacacaccaacaagcactcaaaaacacacctcagggttacgaaggggccgcttacccttggacttctggtcgttttggcaactgcacagccaccgggccttgtttaaattacgaatatcacattaactcagccatagcaatggctgcttgggaattgtacatcagtggagcagtagacgatcaatacttagagagtacagtctacccattgatttcagacgctgcaaagttctacgccgattacgtaacatcatataacgaaactatcgacaagttcattacatcaaacctaaccgacccagatgaatacgctaatcacgtagacaatggtgcctatacaaatgccggtattgcccttcttatgaattggatcaatgacatcggcgacatcctggggattaagatgccagaaatttacactgatatatctcaaaagatgtatctcccaactgcggataattctcaaaacattaccttagaatactctggtatgaactcctctgtcggaatcaaacaagctgatgttgtccttatgacatacccacttcagaactctctagttgacgatgaacaggcatacattaacatggagttttactcaggaaaacaagtttcttacggaccagcaatgaccttctctatattttctattgtcgcagcaaacttggctacatctggttgtgcctcacaatcttacttgcacaaagcaatgcaaccatatcttagaggccctttcgcacaattctccgaacaaaataatgacaacttcaagacaaacggtggaacacatccagcttatccatttcttactgcacatggtgggttcatacaggctgttgtgaacggacttactgggcttagacattcctacacaatcgataatggtaagattcgtagatcactattcttagatcctatcgccttaccttgccttggcgatggggttcaatactccggtattcattacgataatcatacaattagcatgaacattacaggttccaccttcgttatcagaaacgagggcaaaaccaacaagagagcaaacgactatatctctatcactattgccgatagaaatccaggtagaggtacatacaagttgaaggacaatgaagagaaaagcttcaagttataccaaccttctaagatttttgaagattctgtgtcagagtgtggtttggcaactttctacaatataacagaatcagctcctggtgacagctctttctccataaacgatggtgataacactaccagatggcaagttaagtacaatgatacaacaggtaaggtcttgatcgatttgcattcaatcaaaaacatcactggtgttgttttcaactgggctgataagccacctaaaaaggtaaagttgagtaagtacatggggactaagtttaaggatgtcactgactttttggctaaggttgatttcggtaattacgtttacaaaaactacagattcgctaaccctggtgaaaaacttttgaaccaatcagaagtgttcgaaaacgtttactctgatgatgttacaatcaacgcaccattctcttctaaggaactagaggaagttatcgttccagtgagacataatactacatcttggaacattaacttacaaggcagattcttattgttagaagtggacggaatccacaacaccattccaatcgaagatgattacggtggcgcaaagttagccgaagtgaacttcttttagttaattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacgcggccgccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacc

SEQ ID NO: 13 - DNA, 9130 bp, Artificial Sequence
  Sequence put together from multiple organisms, C. glabrata and S. cerevisiae
tgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagttttaaaacactaagaacttagtttcgaataaacacacataaaaacaaatctagaatgaaattcatctctactttccttacttttattttagctgccgtatctgtaaccgcctctaccaactcttacttctcttcctccttagcttctgcttcaccattattcaacaaagagggcagagtggttagaccaatgcgtgaaagtaacttaggcctacacgcagatcctcaaactagaaaatccagtaagacactttacgatttgttgtcagactttgacaatgcattttacgatgatgaaaacatgatcttaggatccctagccttcggtgagaatacctactccagacagccatacgtcgcaaacgggtacataggtagccgtataccaaacatcggtttcggatacgcacttgatacacttaacttgtacgctgatgcaccaggcgcacttaacaacggttggcctttgagaaacagaagattcgctggaagtttcgtttctgatttctactcactgcaagccaagttgaacagtaccaattttcctgagttagatgaaaagggttatacaactgtcatttcatcaatcccagaatggacagatttgcaattcactgtagaccttaacggcactaactggttcaatccacaatcagttctaatcgatgatgttattaattacaatcagaacttgagcatgaaggatggaattgttagcacaaacatggattggttgaacggaatgataaacattaagtctgaagtctgggcacacagaaagatccattccttgggtatcacacgtctggaaatctcattgaaccttgatgctttacctgacgagttcactgaactaccagttacaatttacgatatcatagatttcaacacttctcatagaacaacactatatgagaaaggtcaagatgaagataacaaagcgatttacatgattgtaaacccagaaaacgtaccatactcaaacgcagttgtgtactctacttgtacaatcaagggcactgaaaacaacttttctccttacaacttcacatcagatgatagaattgcgagaaactacatgacaaacctaacagaagagaacccaaaagtcgttatttacaagtacacatcagtggtttcctcagaatataataatgacgagccaaatcctaacgttaacttgaagttcgcctcaaacatcgctaacaccgcaaaaggaaactataagtctttattgtccaatcacaaaagagcttggtacgatttgtacaatgatgcctttatcgaaattccatctgatagtttattggaaatgaccgcaagatctagtctcttccatttgcttgcgaacacacgtcaatacaacgtttctacaactagaggattaccagtcggcgttggtggtctttcttcagactcttacggggggatggtcttttgggacgcagacgtatggatggctccagctctcctacctttctttccaaacatagcaatgaacatgaataactacagaaacgctactcatcaacaagccattgaaaatgctaagcaatacaattacccaggcgccgtttacccttggacatctggtagatatgcgaattgtacctctaccggtccttgcatcgactacgaataccatattaatgtagatatcgctttggcaagtttctctatttacatgaacggtgccgagggtgccgacgaagattaccttagattcacaacatggccaatggtcaaggatgctgcagtgttcttcaaggcctacgtcaaatacaatgaaacacttggagagtacgaaacttataatttaactgacccagatgaatttgctaatcatgtgaataatggagctttcacaaatgcaggaatcaaaactttgttgaaatgggcaacagacattggtactcaccttggggaggaagttgatcctaagtggatggaaattgctgataacatacatattcctagaagtgactctaacattactttggagtactctggcatgaatagctccgttgagattaagcaggctgacgttacattgatggtataccctttaggttacatcaacgatgaatctatactaaacaacgcaatcaaggatttgtattactactctgaacgtcagtctgcctctgggccagctatgacttacccagtgttcgtcgcagctgccgcttccctcttgaaccacggttcatcatcacagagttacctttacaaatctgttcttccatatctgagatcaccatttgctcaatttagcgaacaatcagatgacaatttcttaactaacggtttgacacaaccagcattcccatttttgaccgctaatggtggtttcttgcaatctatattatttggattaaccggattgagatacagttacgaagttactcctagaaccaaaaagatttcaagactactcaagtttgatccagtcaagttgccactgctacctggcggaattgcaattagaaatttcaaatacatgggacaagtactggatatcataatagacgataacaatggtacaatagctcataagggtggggataagccaattagaatcaaggttccaaatagagatattctccacgacagaaatatcacttccgcactatactcaaagagagatgacgatttatcagcgacagatgactactacggtacatacttcacactatacccaaatgaggaactggtgattcctctttacgatactaagttaaacatcgacggtaacatagccgaatctaaacaaataactaatttgactgccggagttccaggtgacgttggtttctccgcattagatgggaacaattacacacactggcagccattcgataaatcagataatgctaagttgctaattgacttaggttttaacagcactcatgtcattaaaaagggtattattttgtggggtcaaagaccagcgaaaaacatttctttgtcagttttgccacattcagagagaattgagcaactatttgcgaacatcacagatcttttagaaacatcatctataactaagggcggctctttgttaaaccagatgttaggccaaacacaatcaaacgtgaccgcagaaattgatgatgatatcctcgctttactgaactggaaaggtgacgatctggaccaactcatcccttatttgcctgatatgcatctcctacaagagaaattcattcctattttgaaggattaccctattaagccaaatcagagatactataaggaaatcattgacgatgacataatcaagttattaccatcaaacacaactgaatttacaatcgattacaattctatccctggcggggaaaagcgtgcaagatacgttgttctgacagttcacggcacctatgatgacgatgatgatcttaaaggtgcaacaatcaaggaaattgttctgcaggaatgattaattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacgcggccgccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatt

SEQ ID NO: 14 - protein, 1128 aa, Artificial Sequence
  Sequence put together from multiple organisms, C. glabrata and S. cerevisiae
MKFISTFLTFILAAVSVTASTNSYFSSSLASASPLFNKEGRVVRPMRESNLGLHADPQTRKSSKTLYDLLSDFDNAFYDDENMILGSLAFGENTYSRQPYVANGYIGSRIPNIGFGYALDTLNLYADAPGALNNGWPLRNRRFAGSFVSDFYSLQAKLNSTNFPELDEKGYTTVISSIPEWTDLQFTVDLNGTNWFNPQSVLIDDVINYNQNLSMKDGIVSTNMDWLNGMINIKSEVWAHRKIHSLGITRLEISLNLDALPDEFTELPVTIYDIIDFNTSHRTTLYEKGQDEDNKAIYMIVNPENVPYSNAVVYSTCTIKGTENNFSPYNFTSDDRIARNYMTNLTEENPKVVIYKYTSVVSSEYNNDEPNPNVNLKFASNIANTAKGNYKSLLSNHKRAWYDLYNDAFIEIPSDSLLEMTARSSLFHLLANTRQYNVSTTRGLPVGVGGLSSDSYGGMVFWDADVWMAPALLPFFPNIAMNMNNYRNATHQQAIENAKQYNYPGAVYPWTSGRYANCTSTGPCIDYEYHINVDIALASFSIYMNGAEGADEDYLRFTTWPMVKDAAVFFKAYVKYNETLGEYETYNLTDPDEFANHVNNGAFTNAGIKTLLKWATDIGTHLGEEVDPKWMEIADNIHIPRSDSNITLEYSGMNSSVEIKQADVTLMVYPLGYINDESILNNAIKDLYYYSERQSASGPAMTYPVFVAAAASLLNHGSSSQSYLYKSVLPYLRSPFAQFSEQSDDNFLTNGLTQPAFPFLTANGGFLQSILFGLTGLRYSYEVTPRTKKISRLLKFDPVKLPLLPGGIAIRNFKYMGQVLDIIIDDNNGTIAHKGGDKPIRIKVPNRDILHDRNITSALYSKRDDDLSATDDYYGTYFTLYPNEELVIPLYDTKLNIDGNIAESKQITNLTAGVPGDVGFSALDGNNYTHWQPFDKSDNAKLLIDLGFNSTHVIKKGIILWGQRPAKNISLSVLPHSERIEQLFANITDLLETSSITKGGSLLNQMLGQTQSNVTAEIDDDILALLNWKGDDLDQLIPYLPDMHLLQEKFIPILKDYPIKPNQRYYKEIIDDDIIKLLPSNTTEFTIDYNSIPGGEKRARYVVLTVHGTYDDDDDLKGATIKEIVLQE

SEQ ID NO: 15 - DNA, 9382 bp, Artificial Sequence
  Sequence put together from multiple organisms, C. glabrata and S. cerevisiae
aaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgagatctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagttttaaaacactaagaacttagtttcgaataaacacacataaaaacaaatctagaatgggtttcaaggacaagattctgttctggaaagacgaagttcaatatagaacacttgcagttgctgatcaagtggccaacagattctttcatagcttcgaaaatgtatacaagggtgatgagtctgtcgaagatgcggattcaagacctgttggtttgaccaatgaaaccctatcacattcatctgatttctttgttttgccagaagagagaatctctactagagtcaagattagacgtcagaatatcctaaacacaacactcattttggggatgctgatcgcacttgtaatatggactgccattttgtctacaaactcttacttctcttcctccttagcttctgcttcaccattattcaacaaagagggcagagtggttagaccaatgcgtgaaagtaacttaggcctacacgcagatcctcaaactagaaaatccagtaagacactttacgatttgttgtcagactttgacaatgcattttacgatgatgaaaacatgatcttaggatccctagccttcggtgagaatacctactccagacagccatacgtcgcaaacgggtacataggtagccgtataccaaacatcggtttcggatacgcacttgatacacttaacttgtacgctgatgcaccaggcgcacttaacaacggttggcctttgagaaacagaagattcgctggaagtttcgtttctgatttctactcactgcaagccaagttgaacagtaccaattttcctgagttagatgaaaagggttatacaactgtcatttcatcaatcccagaatggacagatttgcaattcactgtagaccttaacggcactaactggttcaatccacaatcagttctaatcgatgatgttattaattacaatcagaacttgagcatgaaggatggaattgttagcacaaacatggattggttgaacggaatgataaacattaagtctgaagtctgggcacacagaaagatccattccttgggtatcacacgtctggaaatctcattgaaccttgatgctttacctgacgagttcactgaactaccagttacaatttacgatatcatagatttcaacacttctcatagaacaacactatatgagaaaggtcaagatgaagataacaaagcgatttacatgattgtaaacccagaaaacgtaccatactcaaacgcagttgtgtactctacttgtacaatcaagggcactgaaaacaacttttctccttacaacttcacatcagatgatagaattgcgagaaactacatgacaaacctaacagaagagaacccaaaagtcgttatttacaagtacacatcagtggtttcctcagaatataataatgacgagccaaatcctaacgttaacttgaagttcgcctcaaacatcgctaacaccgcaaaaggaaactataagtctttattgtccaatcacaaaagagcttggtacgatttgtacaatgatgcctttatcgaaattccatctgatagtttattggaaatgaccgcaagatctagtctcttccatttgcttgcgaacacacgtcaatacaacgtttctacaactagaggattaccagtcggcgttggtggtctttcttcagactcttacggggggatggtcttttgggacgcagacgtatggatggctccagctctcctacctttctttccaaacatagcaatgaacatgaataactacagaaacgctactcatcaacaagccattgaaaatgctaagcaatacaattacccaggcgccgtttacccttggacatctggtagatatgcgaattgtacctctaccggtccttgcatcgactacgaataccatattaatgtagatatcgctttggcaagtttctctatttacatgaacggtgccgagggtgccgacgaagattaccttagattcacaacatggccaatggtcaaggatgctgcagtgttcttcaaggcctacgtcaaatacaatgaaacacttggagagtacgaaacttataatttaactgacccagatgaatttgctaatcatgtgaataatggagctttcacaaatgcaggaatcaaaactttgttgaaatgggcaacagacattggtactcaccttggggaggaagttgatcctaagtggatggaaattgctgataacatacatattcctagaagtgactctaacattactttggagtactctggcatgaatagctccgttgagattaagcaggctgacgttacattgatggtataccctttaggttacatcaacgatgaatctatactaaacaacgcaatcaaggatttgtattactactctgaacgtcagtctgcctctgggccagctatgacttacccagtgttcgtcgcagctgccgcttccctcttgaaccacggttcatcatcacagagttacctttacaaatctgttcttccatatctgagatcaccatttgctcaatttagcgaacaatcagatgacaatttcttaactaacggtttgacacaaccagcattcccatttttgaccgctaatggtggtttcttgcaatctatattatttggattaaccggattgagatacagttacgaagttactcctagaaccaaaaagatttcaagactactcaagtttgatccagtcaagttgccactgctacctggcggaattgcaattagaaatttcaaatacatgggacaagtactggatatcataatagacgataacaatggtacaatagctcataagggtggggataagccaattagaatcaaggttccaaatagagatattctccacgacagaaatatcacttccgcactatactcaaagagagatgacgatttatcagcgacagatgactactacggtacatacttcacactatacccaaatgaggaactggtgattcctctttacgatactaagttaaacatcgacggtaacatagccgaatctaaacaaataactaatttgactgccggagttccaggtgacgttggtttctccgcattagatgggaacaattacacacactggcagccattcgataaatcagataatgctaagttgctaattgacttaggttttaacagcactcatgtcattaaaaagggtattattttgtggggtcaaagaccagcgaaaaacatttctttgtcagttttgccacattcagagagaattgagcaactatttgcgaacatcacagatcttttagaaacatcatctataactaagggcggctctttgttaaaccagatgttaggccaaacacaatcaaacgtgaccgcagaaattgatgatgatatcctcgctttactgaactggaaaggtgacgatctggaccaactcatcccttatttgcctgatatgcatctcctacaagagaaattcattcctattttgaaggattaccctattaagccaaatcagagatactataaggaaatcattgacgatgacataatcaagttattaccatcaaacacaactgaatttacaatcgattacaattctatccctggcggggaaaagcgtgcaagatacgttgttctgacagttcacggcacctatgatgacgatgatgatcttaaaggtgcaacaatcaaggaaattgttctgcaggaatgattaattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacgcggccgccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataaca

SEQ ID NO: 16 - protein, 515 aa, Saccharomycopsis fibuligera
MIRLTVFLTAVFAAVASCVPVELDKRNTGHFQAYSGYTVARSNFTQWIHEQPAVSWYYLLQNIDYPEGQFKSAKPGVVVASPSTSEPDYFYQWTRDTAITFLSLIAEVEDHSFSNTTLAKVVEYYISNTYTLQRVSNPSGNFDSPNHDGLGEPKFNVDDTAYTASWGRPQNDGPALRAYAISRYLNAVAKHNNGKLLLAGQNGIPYSSASDIYWKIIKPDLQHVSTHWSTSGFDLWEENQGTHFFTALVQLKALSYGIPLSKTYNDPGFTSWLEKQKDALNSYINSSGFVNSGKKHIVESPQLSSRGGLDSATYIAALITHDIGDDDTYTPFNVDNSYVLNSLYYLLVDNKNRYKINGNYKAGAAVGRYPEDVYNGVGTSEGNPWQLATAYAGQTFYTLAYNSLKNKKNLVIEKLNYDLYNSFIADLSKIDSSYASKDSLTLTYGSDNYKNVIKSLLQFGDSFLKVLLDHIDDNGQLTEEINRYTGFQAGAVSLTWSSGSLLSANRARNKLIELL

SEQ ID NO: 17 - protein, 579 aa, Rhizopus oryzae
ASIPSSASVQLDSYNYDGSTFSGKIYVKNIAYSKKVTVVYADGSDNWNNNGNTIAASFSGPISGSNYEYWTFSASVKGIKEFYIKYEVSGKTYYDNNNSANYQVSTSKPTTTTAATTTTTAPSTSTTTRPSSSEPATFPTGNSTISSWIKKQEDISRFAMLRNINPPGSATGFIAASLSTAGPDYYYAWTRDAALTSNVIVYEYNTTLSGNKTILNVLKDYVTFSVKTQSTSTVCNCLGEPKFNPDGSGYTGAWGRPQNDGPAERATTFVLFADSYLTQTKDASYVTGTLKPAIFKDLDYVVNVWSNGCFDLWEEVNGVHFYTLMVMRKGLLLGADFAKRNGDSTRASTYSSTASTIANKISSFWVSSNNWVQVSQSVTGGVSKKGLDVSTLLAANLGSVDDGFFTPGSEKILATAVAVEDSFASLYPINKNLPSYLGNAIGRYPEDTYNGNGNSQGNPWFLAVTGYAELYYRAIKEWISNGGVTVSSISLPFFKKFDSSATSGKKYTVGTSDFNNLAQNIALAADRFLSTVQLHAPNNGSLAEEFDRTTGFSTGARDLTWSHASLITASYAKAGAPAA

SEQ ID NO: 18 - protein, 621 aa, Aspergillus shirousami
SVISKRATLDSWLSNEATVARTAILNNIGADGAWVSGADSGIVVASPSTDNPDYFYTWTRDSGIVLKTLVDLFRNGDTDLLSTIEHYISSQAIIQGVSNPSGDLSSGGLGEPKFNVDETAYAGSWGRPQRDGPALRATAMIGFGQWLLDNGYTSAATEIVWPLVRNDLSYVAQYWNQTGYDLWEEVNGSSFFTIAVQHRALVEGSAFATAVGSSCSWCDSQAPQILCYLQSFWTGSYILANFDSSRSGKDTNTLLGSIHTFDPEAGCDDSTFQPCSPRALANHKEVVDSFRSIYTLNDGLSDSEAVAVGRYPEDSYYNGNPWFLCTLAAAEQLYDALYQWDKQGSLEITDVSLDFFKALYSGAATGTYSSSSSTYSSIVSAVKTFADGFVSIVETHAASNGSLSEQFDKSDGDELSARDLTWSYAALLTANNRRNSVVPPSWGETSASSVPGTCAATSASGTYSSVTVTSWPSIVATGGTTTTATTTGSGGVTSTSKTTTTASKTSTTTSSTSCTTPTAVAVTFDLTATTTYGENIYLVGSISQLGDWETSDGIALSADKYTSSNPPWYVTVTLPAGESFEYKFIRVESDDSVEWESDPNREYTVPQACGESTATVTDTWR

SEQ ID NO: 19 - protein, 616 aa, Aspergillus terreus
APQLAPRATTSLDAWLASETTVALDGILDNVGSSGAYAKSAKSGIVIASPSTSDPDYYYTWTRDAALTVKALIDLFRNGETSLQTVIMEYISSQAYLQTVSNPSGSLSTGGLAEPKYYVDETAYTGSWGRPQRDGPALRATAMIDFGNWLIDNGYSTYASSIVWPIVRNDLSYVAQYWNQTGYDLWEEVNGSSFFTIAVQHRALVEGSTFASKVGASCSWCDSQAPQVLCFLQRFWTGSYIMANFGGGRSGKDANTVLGSIHTFDPNAGCDDTTFQPCSPRALANHKVYTDSFRSIYSINSGISSGKAVAVGRYPEDSYYNGNPWFLTTLAAAEQLYDAIYQWQKIGSITITDVSLAFFKDLYSSAAVGTYASSSSAFTSIVSAVKTYADGYMSIVQTHAMTNGSLSEQFGKSDGFSLSARDLTWSYAALLTANLRRNSVVPPSWGETTATSVPSVCSATSATGTYSTATNTAWPSTLTSGTGATTTTSKATSSSTTTTSSASSTTVECVVPTAVAVTFDEVATTTYGENVYVVGSISQLGSWDTSKAVALSASKYTSSNNLWYVTVTLPAGTTFQYKFIRVSSSGSVTWESDPNRSYTVPSACGTSTAVVNTTWR

SEQ ID NO: 20 - protein, 617 aa, Saccharomyces mikatae
MKNFISLVNKKKGTLDDRNSSVPESSSGIIHQRGALNTEDFEEGKKDGAFELGHLEFTTNSAQLGDSDDDNDNAIKIANAATDEANEANSEEKSMTLRQALRKYPKAALWSILVSTTLVMEGYDTALLSALYALPVFQRKFGTMNAEGSYEITSQWQIGLNMCVLCGEMIGLQMTTYMVEFMGNRYTMITALGLLTAYIFILYYCKSLAMIAVGQILSAMPWGCFQSLAVTYASEVCPLALRYYMTSYSNICWLFGQIFASGIMKNSQENLGDSDLGYKLPFALQWIWPAPLIIGIFFAPESPWWLVRKNKIAEAKKSLNRILSGTAAEREIQVDITLKQIEMTIEKERLLASKSGSFFNCFKGVDGRRTRLACLTWVAQNSSGAVLLGYSTYFFERAGMATDKAFTFSLIQYCLGLAGTLCSWVISGRVGRWSILAYGLAFQMVCLFIIGGMGFASGSNASNGAGGLLLALSFFYNAGIGAVVYCIVAEIPSAELRTKTIVMARICYNLMAVINAILTPYMLNVSDWNWGAKTGLYWGGFTAVTLAWVIIDLPETTGRTFSEINELFNQGVPARKFASTVVDPFGKGQRQNDSQVDNVIDQSSSAMQQELNEANEF

SEQ ID NO: 21 - DNA, 1928 bp, Saccharomyces cerevisiae
caagctataccaagcatacaatcaactatctcatatacaatgaaaaacatcatttcattagtttctaagaagaaggctgcatccaaaaatgaagataaaaacatctctgaatcttcaagagatatcgttaatcaacaagaggttttcaataccgaagatttcgaggaaggcaaaaaggactctgcattcgaattagatcacttggagtttactaccaactccgcacaattaggcgactctgatgaggacaacgaaaacgtcattaacgaaatgaacgcaacagacgatgcaaacgaagcaaactctgaagagaaatccatgaccttgaagcaagcattgttgaagtatcctaaagccgcattatggtctattttagtctccactactttggtcatggaaggttacgacactgctttgttatccgcattatacgctttaccagtttttcaacgtaagtttggtacattgaatggtgaaggttcctatgagattacatcccaatggcagattggtcttaacatgtgcgtcttgtgtggtgaaatgattggtttacaaatcaccacctatatggttgagtttatgggtaacagatacactatgatcaccgctttaggtcttttgactgcttacattttcattttgtactattgtaagtccttagccatgattgctgttggtcaaattttgtccgccatcccttggggttgttttcaatctttggctgttacctatgcttctgaagtctgcccattagcacttagatactatatgacttcctattctaacatttgctggttgttcggccaaatcttcgcatctggtatcatgaaaaactcacaagagaacttaggcaattccgatcttggttacaaacttccatttgctttacagtggatttggcctgccccacttatgattggtattttctttgctccagaatctccttggtggcttgttagaaaagatagagttgcagaagctagaaagtcattatccagaattttgtctggtaagggcgctgaaaaggatattcaagttgatcttaccttaaagcagattgaattaactattgaaaaggaaagattattagcttctaagtctggttcattctttaactgtttcaagggtgttaatggtcgtagaaccagattagcatgtttaacctgggttgcccaaaactcctccggtgcagttttgttaggttattctacttactttttcgaaagagctggtatggcaacagacaaggctttcacattctcattaatccagtactgtttgggtcttgcaggcaccttatgttcatgggttatttcaggtagagtcggtagatggactatcttgacttatggtcttgcttttcaaatggtctgtttgttcattatcggtggtatgggttttggttctggttcctctgcttccaatggtgctggtggcttattgttggcattatcctttttctacaatgcaggcatcggtgctgttgtctattgtattgtcgccgaaattccttcagcagaattgagaaccaagactattgttttggctagaatctgttacaatttgatggccgttatcaatgctattttgaccccatacatgttgaacgtttctgactggaactggggtgctaagacaggcttgtattggggtggtttcactgcagttactttggcttgggttattatcgacttaccagaaaccactggtagaacattctctgaaatcaatgaattattcaaccaaggtgttccagctcgtaagttcgcatctactgtcgtcgatccattcggtaagggtaagacccaacatgattccttggccgatgaatccatctctcaatcttcatccattaagcaaagagaattgaatgcagcagataagtgttaattaattaaacaggccccttttcctttgtcgatatcatg

SEQ ID NO: 22 - protein, 523 aa, Issatchenkia orientalis
MSDLESQHTREELDKSEDEEIQLINESRPPKLDKETIKRYLKTRFTELLPTKQQMKQNKHLLNPLPGLRMMGRRQWLMFLSAFCAWTWDAYDFFTVSLNTVQLAKDFDKNVKDITWGITLVLMLRSVGGITFGYLGDRYGRKWPLVANLLIVCILEIGSGFIKTYRQFLGVRALFGICLGGVYGNATATALDDCPTEARGFIGGLLQQGYAFGYLLAVVFKRAIADNSSHKWRATFWFGAGISFLFALFRASLPETKAFLRKKEIERYNKEHGIYQPTFQMKIVESLKNYWLMMIYLVLFMSGFSFMSHSSQDLYPTLLTVRYSFSENKATVTNCVANIGAFIGGVFTGHISNFLGRRLTIMLICIFGGALIYPWAFIDGTGINAGVFFLQWCVQGGLGVVPSHLSELAPPDLRAFVVGISYQLGNLAASASSTIETTIGEQFPMTSPSGEPIYDYAKVMAIFVGCVFAFVLIVTLFGPERRNASFENAVTTNEEFGNSAGAVDKIEHVEECIVPKHARNQQC

SEQ ID NO: 23 - protein, 616 aa, Saccharomyces cerevisiae
MSSSITDEKISGEQQQPAGRKLYYNTSTFAEPPLVDGEGNPINYEPEVYNPDHEKLYHNPSLPAQSIQDTRDDELLERVYSQDQGVEYEEDEEDKPNLSAASIKSYALTRFTSLLHIHEFSWENVNPIPELRKMTWQNWNYFFMGYFAWLSAAWAFFCVSVSVAPLAELYDRPTKDITWGLGLVLFVRSAGAVIFGLWTDKSSRKWPYITCLFLFVIAQLCTPWCDTYEKFLGVRWITGIAMGGIYGCASATAIEDAPVKARSFLSGLFFSAYAMGFIFAIIFYRAFGYFRDDGWKILFWFSIFLPILLIFWRLLWPETKYFTKVLKARKLILSDAVKANGGEPLPKANFKQKMVSMKRTVQKYWLLFAYLVVLLVGPNYLTHASQDLLPTMLRAQLGLSKDAVTVIVVVTNIGAICGGMIFGQFMEVTGRRLGLLIACTMGGCFTYPAFMLRSEKAILGAGFMLYFCVFGVWGILPIHLAELAPADARALVAGLSYQLGNLASAAASTIETQLADRYPLERDASGAVIKEDYAKVMAILTGSVFIFTFACVFVGHEKFHRDLSSPVMKKYINQVEEYEADGLSISDIVEQKTECASVKMIDSNVSKTYEEHIETV

SEQ ID NO: 24 - protein, 600 aa, Kluyveromyces lactis
MNNNNITPESDSMKSNDNDQTNDYMPDVADFDHTQTNTNEIARAISHPGSVLSRVASYVSRKDRYVDENGNEVWQDDEVSILMEEDETPDFTWKNIRHYAITRFTTLTELHRVSMENINPIPELRKMTLHNWNYFFMGYAAWLCAAWAFFAVSVSTAPLATLYGKETKDISWGLSLVLFVRSAGAIIFGIWTDNYSRKWPYITCLGLFLICQLCTPWAKTYTQFLGVRWISGIAMGGIYACASATAIEDAPVKARSFLSGLFFTAYAMGFIFAIIFYRAFLNVNGENYWKVQFWFSIWLPAVLILWRLVWPETKYFTKVLKARQLMRDDAIAKNGGQPLPKLSFKQKFANVKKTVSKYWLLFGYLILLLVGPNYLTHASQDLFPTMLRAQLRFSEDAVTVAIVVVCLGSIAGGMFFGQLMEITGRRVGLLLALIMAGCFTYPAFMLKTSSAVLGAGFMLWFSILGVWGVLPIHLSELSPPEARALVSGLAYQLGNLASAASVVIENDLADLYPIEWNSAGEVTNKDYSKVMAILTGSSVIFTFVLVFVGHEKFHRDLSSPHLKSYIERVDQTEEVAAMTGSTANSISSKPSDDQLEKVSV

SEQ ID NO: 25 - protein, 606 aa, Kluyveromyces dobzhanskii
MHTISPESDSLKSSKSNTNSHEYMSATTDYNNGGASAAPLSAKRKETGNSYELQDHAASASASASASASASASASALAFDYDPEDDDVSIMMQDEEVPDLTWKHVSNYAITRFTSLAHIHPVSMQNINPFPELRKMTLHNWNYFFMGYGAWLCASWAFFAVSVSTAPLAELYDKQTKDISWGLSLVLFVRSAGAIIFGIWTDNYSRKWPYITCLGLFLICQLCTPFATNYTQFLGVRWISGVAMGGIYACASATAIEDAPVKARSFLSGLFFTAYAMGFIFATVFYRAFLNINGKDYWKIQFWFSIWLPAALILWRLVWPETRYFTKVLKARQLMLDDAIAANGGQPLPKKTFQEKVTNVKKIISTYWLLFTYLILLLVGPNYLTHASMDLFPTMLRAQLKFSEDAVTVAIVVVCIGAICGGMFFGQLMEITGRRLGLLIALVMAGCFTYPAFMLNTGPAVLGGGFFLWFSVIGVWGVIPIHLSELSPPEARALVSGLAYQLGNLASAASVVIESDLADLYPIAWNAAGEVTNKNYSKVMAILTGSVVIFTFVLVLVGHEKFHRDLSSPHLKEYTDRVDRAEEAAGMGSSAASVSSKPEQNFVEKV

SEQ ID NO: 26 - protein, 604 aa, Kluyveromyces marxianus
MSEGNEEKGQGQGQGQDHGHFPEGRTFLHQVESKRSVHTHHSVPMNSSDSQSNASDPEELAPFPSVVDESELDESELEEIQNEDVSIIYKDDEEKPDLSWASICRYAGTRITSLFQIHKVSMDNINPFPELRKMTLSNWNYFFMGYLAWLCAAWAFFAVSVSTAPLAKLYDKPTKDISWGLSLVLFVRSAGAIIFGLWTDNYSRKWPYITCLGLFLICQLCTPWAKTYTQFLGVRWISGIAMGGIYGCASATAIEDAPVKARSILSGLFFSAYAMGFIFAIIFYRAFLHVNGENYWKVQFWFSIFLPALLMLWRLVWPETKYFTKVLKARELMKQDAIASNGGNPIPKTTFKEKMANTKRIICKYWLLFGYLVLLLVGPNYLTHGSQDLFPTMIRSQLNFSEDAVTVAIVVVNLGGICGGLFFGQLMEVTGRRLGLLIALTMAGCFTYPAFMLKTSSAVLGAGFMLFFSVFGVWGVIPIHLSELSPPEARALVAGLAYQLGNLASAASVVIENDLADIYPLARDAAGKVIKKDYAKVMAILTGSVVIFTFVMVLIGHEKFHRDLSSAVLKAYMEKVDRNEEDARLGVSSLSISSKSKEEQVENA

SEQ ID NO: 27 - protein, 591 aa, Saccharomyces cerevisiae
MLKYKPLLKISKNCEAAILRASKTRLNTIRAYGSTVPKSKSFEQDSRKRTQSWTALRVGAILAATSSVAYLNWHNGQIDNEPKLDMNKQKISPAEVAKHNKPDDCWVVINGYVYDLTRFLPNHPGGQDVIKFNAGKDVTAIFEPLHAPNVIDKYIAPEKKLGPLQGSMPPELVCPPYAPGETKEDIARKEQLKSLLPPLDNIINLYDFEYLASQTLTKQAWAYYSSGANDEVTHRENHNAYHRIFFKPKILVDVRKVDISTDMLGSHVDVPFYVSATALCKLGNPLEGEKDVARGCGQGVTKVPQMISTLASCSPEEIIEAAPSDKQIQWYQLYVNSDRKITDDLVKNVEKLGVKALFVTVDAPSLGQREKDMKLKFSNTKAGPKAMKKTNVEESQGASRALSKFIDPSLTWKDIEELKKKTKLPIVIKGVQRTEDVIKAAEIGVSGVVLSNHGGRQLDFSRAPIEVLAETMPILEQRNLKDKLEVFVDGGVRRGTDVLKALCLGAKGVGLGRPFLYANSCYGRNGVEKAIEILRDEIEMSMRLLGVTSIAELKPDLLDLSTLKARTVGVPNDVLYNEVYEGPTLTEFEDA

SEQ ID NO: 28 - protein, 578 aa, Issatchenkia orientalis
MLLRSLNSSARCVKQTTRTKVRYLSHVSGASMAKPTLKNNSRESNKSRNYLIAAVTALAVSTSIGVAVHVKDPLYNDATGSDSPRSISVDEFVKHNSQNDCWIAINGKVYDFTDFIPNHPGGVPPLVNHAGYDGTKLYEKLHPKGTIEKFLPKDKFLGVLDGEAPKLEADYLVDDDEQERLDYLNNLPPLSSIQNVYDFEYLAKKILPKDAWAYYSCGADDEITMRENHYAYQRVYFRPRICVDVKEVDTSYEMLGTKTSVPFYVSATALAKLGHPDGECSIARGAGKEGVVQMISTLSSMSLDEIAAARIPGATQWFQLYINEDRNVAKGLVKHAEDLGMKAIFITVDAPSLGNREKDKRLKFVNDTDVDLGDSADRNSGASKALSSFIDASVSWNDVKAVKSWTKLPVLVKGVQTVEDVIEAYDAGCQGVVLSNHGGRQLDTAPPPIELLAETVPTLKRLGKLRPDFEILIDGGVKRGTDILKAVAIGGQDVRVSVGMGRPFLYANSCYGEAGVRKLIQNLKDELEMDMRLLGVTKMDQLSSKHVDTKRLIGRDAINYLYDNVYSPIETVKFNNED

SEQ ID NO: 29 - protein, 423 aa, Saccharomyces kluyveri
MPQDLVCSPLTPGETPDDIVRKEELRSRLPSLDALVNLYDFEYLASQILTKQAWSYYSSAADDEVTHRENHAAYHRIFFKPKVLVDVREVDTSTKILGQDVPVPFYVSATALCKLGNPKEGEKDVARGCGQGPIKCPQMISTLASCSLQEIVEAAPSKEQIQWFQLYVNTDRKITDDLIKQVEKLGLKAIFVTVDAPSLGRREKDMKVKFTNSNGAKAMEKTKVKESKGASAALSTFIDPALSWDDIVEIKKKTNLPIVIKGVQRVEDVLKAAEVGAAGVVLSNHGGRQLDFSRAPIEVLAESVPVLKERNLSDKLEIFIDGGVRRGNDVLKALCLGAKGVGLGRPFLYANSCYGKDGVQKAIEMLTEEIQMSMRLLGVTKIEDLKPELLDMSSFSGRTVNVPQDSLYRSVYEKSETVQFLDE

SEQ ID NO: 30 - protein, 591 aa, Saccharomyces bayanus
MLKYKSLLRISRVSEAAALRTSRTRLNTVRSYSSAVGKSKSFEKHSGKRTQSWTALSVGAILAAAGSMAYVNWGSGQIGNDPKLDMNKQKISPAEVAKHNSADDCWVVINGYVYDLTRFVPNHPGGPDVIKYNAGRDVTAIFEPLHAPNVIDKYIAPEKKLGPLQGSMPPELVCPPYAPGETKEDIARKEQLKSLLPPLDNIINLYDFEYLASQTLTRQAWAYYSSGSNDEVSHRENHNAYHRIFFKPKILVDVSKVDISTDMLGSHVDVPFYVSATALCKLGNPLEGEKDIARGCGQGATKVPQMISTLASCSPEEIISAAPSDEQIQWYQLYVNSDRKITDELVKSVEKLGVKALFVTVDAPSLGQREKDMKLKFSNSKAGPKAMKKTDVEESKGASRALSKFIDPSLTWKDIEELKSKTNLPIVIKGVQRTEDVVKAAEVGVSGVVLSNHGGRQLDFSRAPIEVLAEAMPVLEERKLKDKLEVYIDGGVRRGTDILKALCLGAKGVGLGRPFLYANSCYGRDGVEKAIEILRDEVEMSMRLLGVASVAELKPELLDLSTLKARTVAVPNDVLYNEVYEGPTLTDFEDA

SEQ ID NO: 31 - protein, 598 aa, Zygosaccharomyces rouxii
MWFRSKPIWKLSEVTARSLRGINTKRSFTWNSKGSNAFVRSSILKKRSMATALLVTAVAAASSVKLSSRPLDNGPKVDMSKPAISPDEVAKHNSPDDCWVVIDGYVYDLTEFAPVHPGGPTVIKSNAGKDVSAIFDPLHAPDVIEKFIDPSKRLGPLEGDMPKELVCAPFTPGETPDDVQRKLKLRARLPPLDAITNLYDFEFLASQVLTKQAWAYYSSGADDEITMRENHFAYHRIFFKPKVLVNVAEVDTKTEMLGAPVDVPFYVTATALCKLGNPAEGEKDIARGCGSGEKKVPQMVSTLASCSLEEVVNAGKEDQIRWFQLYMNEDRSVVDQMISSAEKLGYKGIFVTVDAPGLGNREKDTKVKFSSQAGPLSVKKKEKEDKGKDNGESSGASKYLSKFIDPSFDWDDLVEVKKKTKLPIVIKGVQRVEDVVKAAEVGASGVVLSNHGGRQLDFSRSPIEVLAEAQPILKERNFENFDVFVDGGIRRGTDVVKALCLGAKGVGLGRPFLYANSVYGKEGVQKAIDILNFEVEMTMRLLGVTSIKQLGPELIDTSCIKSRSVQVPRDYLYDKTYMSSDLVSFMPPQEDEADGENE

SEQ ID NO: 32 - protein, 589 aa, Kluyveromyces lactis
MRSAVRVFGKNRVSGLRFASTSSKSPIHKSSATLRFGRSAKSGYSAFSFGKKVITGGAFLVAGSVGIALISQFNDSVENGAKVDMTKPKVSPTEVAKHSSPKDCWVVIEGYVYNLTDFISAHPGGPAIIENNAGKDVTKIFAPIHAPDVIEKYIAPENRIGPLDGTMPDDLVCAALTPGETPEDVARKEQLRQSLPDIDSLVNIYDFEFLASQILTKQAWSYYSSAADDEVTHRENHAAYHRIFFKPRILVNVKEVDTSTTMLGEKVGVPFYVSATALCKLGNPKEGEKDIARGCGESDVKPVQMISTLASCSLQEIVEAAPSKEQIQWFQLYVNSDRKITEDLIKNVEKLGLKAIFVTVDAPSLGNREKDAKVKFTNSNGAKAMEKSKVKESKGASRALSSFIDPALNWDDIIEFKKKTKLPIVIKGVQCVEDVLKAAEIGVAGVVLSNHGGRQLDFSRAPIEVLAETMPVLREKKLDDKIEIFIDGGVRRGTDILKALCLGAKGVGLGRPFLYSNSCYGKEGVKKAIELLKDELEMSMRLLGVTSIDQLSEKYLDLSTIHGRTVNVPRDNLYREVYVPHEPTQFLEE

SEQ ID NO: 33 - protein, 592 aa, Kluyveromyces dobzhanskii
MRSAVRVFRKNRFPTGLRLSSTASSARQGIALSVGKYNKYNKNGTNGSWKSSRKSTTYGGAFLVASAVAIAFSSQITQSLENGVKVDMGKPSVSPAEVVKHSSPDDCWVVIDGYVYNLTEFIGAHPGGPAIIKNNAGKDVTKIFAPIHAPDVIEKYIAPKNRLGPLEGTMPEDRICAALTPGETAEDVARKEQLRQLLPDVNNLTNLYDFEFLASQILTKQAWSYYSSAADDEVTQRENHAAYHRIFFKPRILVNVKEVDTSTTMLGEKVGVPFYVSATALCKLGNPQEGEKDIARGCGESDAKPVQMISTLASCSLQEIVEAAPSKEQIQWFQLYVNSDRKITDDLVKNAEKLGLKAIFVTVDAPSLGNREKDAKVKFTNSNGAKAMEKSNVDESKGASRALSSFIDPALNWDDIVELKTKTKLPIVIKGVQCVEDVLKAAEVGAAGVVLSNHGGRQLDFSRAPIEVLAETMPALREKKLDDKLEVFIDGGVRRGTDILKALCLGAKGVGLGRPFLYSNSCYGKEGVKKAIELLKDELEMSMRLLGVTSIDQLSEKYLDLSTIHGRTVSVPRDNIYRDVYVAQEPSQFRED

SEQ ID NO: 34 - protein, 587 aa, Saccharomyces cerevisiae
MLWKRTCTRLIKPIAQPRGRLVRRSCYRYASTGTGSTDSSSQWLKYSVIASSATLFGYLFAKNLYSRETKEDLIEKLEMVKKIDPVNSTLKLSSLDSPDYLHDPAKIDKVVEDLKQVLGNKPENYSDAKSDLDAHSDTYFNTHHPSLEQRPRIILFPHTTEEVSKILKICHDNNMPVVPFSGGTSLEGHFLPTRIGDTITVDLSKFMNNVVKFDKLDLDITVQAGLPWEDLNDYLSDHGLMFGCDPGPGAQIGGCIANSCSGTNAYRYGTMKENIINMTIVLPDGTIVKTKKRPRKSSAGYNLNGLFVGSEGTLGIVTEATVKCHVKPKAETVAVVSFDTIKDAAACASNLTQSGIHLNAMELLDENMMKLINASESTDRCDWVEKPTMFFKIGGRSPNIVNALVDEVKAVAQLNHCNSFQFAKDDDEKLELWEARKVALWSVLDADKSKDKSAKIWTTDVAVPVSQFDKVIHETKKDMQASKLINAIVGHAGDGNFHAFIVYRTPEEHETCSQLVDRMVKRALDAEGTCTGEHGVGIGKREYLLEELGEAPVDLMRKIKLAIDPKRIMNPDKIFKTDPNEPANDYR

SEQ ID NO: 35 - protein, 533 aa, Issatchenkia orientalis
MSRLFKVLKATQFKYVSSFLLGSTISGGVVYYNYKKSLNFSFPPTSTTPITAAPPLQYGDVSKAISEITSKLGPSKITFSESEILHHSDSSFSTDHAKPHERPHAVVYPESTEDVSEVLKICHTLKVPVVPFTGGTSLEGHFISTRNGISVDLSRMNKVLAIHPEDLDAVVQPAVGWEELRDTLSDYNLLFGPDPGPGACIGGMVATSCSGTNAARYGTMRENVVSVKVVLPDGTIVKTKRRPRKSSAGYNLTNLFIGSEGTLGIVTEVTLKLNVKPKYESVALVSFDKLKDAAGSVTSFVQEGLQLNAIELLDDKMVHFVNESGETDLKYDELPTLLLKIGGSSPESVNLLIKTVERIVNANNAKTFKFASNEEEKYQLWNARKTALWSTIEYGRRNIDKDIQVWTTDVAVPMSKFVEAVEETQKEIEESDLLASIVGHAGDGNYHTVILFKEEQRALAAKLVSNMVDRALAFDGTVSGEHGIGVGKKEFLIDEVGQESVDLMRKIKFSIDPHKILNPDKVFSIDPVNDRSI

SEQ ID NO: 36 - protein, 564 aa, Saccharomyces kluyveri
MFKRAFLRPQLWSSTTRRCTIASIRCYSKQPLKPASASKLTLGLIGGIGLGSAATAYGLLMGDDDTSASTTRLDELAPPSYCQDPKKFEDAIIKLKHILDDNPDNFSVSKSELDAHSDTYFNSHHARPDQRPQIILFPRTTSDVSEILKVCHEYEVPVIPFSGGTSLEGHFLPTRIGCTVVLDMSKYMNKILKLNKQDLDVEVQAGVPWEDLNDYLNSEGVLFGCDPGPGAQIGGCIANSCSGTNAYRYGTMKENIVNITVVLADGTVVKTKRRPRKSSAGYNLNGLFVGSEGTLGVVTQATVKCHVMPKIETVAVVSFPTVGDAASCSSHIIQEGIQLNAMELLDDNMMKVINQSGATSKTDWVESPTLFFKIGGRSQNNVKELVDEVSKIAQKYHCKKFEFASSDDEKLELWEARKVALWSTINAGKAKDSNSNVWTTDVAVPLSQFAPVIEATKQEMNASGLITTLVGHAGDGNFHAFIVYNDDQRDIAEKIVDNMVHRAIEAEGTCTGEHGVGIGKRKFLLHELGAETVDLMRQLKLALDPKRILNPDKIFKIDPNEHEH

SEQ ID NO: 37 - protein, 530 aa, Saccharomyces bayanus
MLRNILVRGAGKHLKYGCRYVKSSALLGCRTKINYYSTKIQTKLTSENYPDVQRDARFKKLTSDDLNYFRSILSEQEVLQASELEDLSFYNEDWMRKYKGQSKLVLRPKTVEKISLILNYCNDEKIAVVPQGGNTGLVGGSVPIFDELILSLANLNKIRDFDPVSGILKCDAGVILENANNYVMEQNYMFPLDLGAKGSCHVGGVVATNAGGLRLLRYGSLHGSVLGLEVVMPNGQIVNSMHSMRKDNTGYDLKQLFIGSEGTIGIITGVSVLTVPKPKAFNVSYLAVESFEDVQKVFVRARQELSEILSAFEFMDSKSQILAKSQLKDATFPLEDEHPFYILIETSGSNKDHDDSKLETFLESVMEEGVVTDGVVAQDETELQNLWKWREMIPEASQANGGVYKYDVSLPLKDLYSLVDATNARLSEAGLVGDSPKPVVGAIGYGHVGDGNLHLNVAVREYNKEIEKVLEPFVYEFVSSKHGSVSAEHGLGFQKKNYIGYSKSPEEVTMIKDLKAHYDPNAILNPYKYV

SEQ ID NO: 38 - protein, 597 aa, Zygosaccharomyces rouxii
MVGSIVLLQPWKRAVSHAVRPRTYQYRYFRTTARISANDKPQSFKNQLYESTQQRLRRERAEQERFSQYQTQSPGGRYAALTFALVFFSTGAYYLGSLKPASLPTSSTTTLFEIEPPLHNISPANLQAAWADFVEILGKENVSTEHGDLDVHSGSDWSSYTLKKDERPFLVLYPSTTEEVSRIMKVCHQRVIPVTPYSGGTSLEGHFAPTRGGVCIDFRRMNRILELHKKDLDVVVQPAVGWEDLNEELSKDGLFFPPDPGPGAMIGGMVGTGCSGTNAYRYGTMREWVLSLTVVLADGTVIKTRQRPRKSSAGYDLTRLFIGSEGTLGLVTEATLKLTVKPKSQSVAVASFPSIHNAAECVTRVVEEGIPVAGVEILDDVQMKCINDSRTTRRQWKESPTLFFKFTGTPVGVKEQIELVRKIVSSSAGQSFEFARGEDEMKELWSARKEALWSVMSMRRGPEDRVWTTDVAVPMSKLPDIIEATKQDMTESGLLAGICGHVGDGNFHAIILFNEDEKKIAEGVVHRMVKRAVEMEGTVTGEHGVGLIKRDYLQHEVGETTVDTMRRIKMALDPLRLLNCDKVVRVEQPTTVELKKW

SEQ ID NO: 39 - protein, 576 aa, Kluyveromyces lactis
MFRFVGRSGFALRGSLQLRKDVLRSRTTAVAKRHYSSSNGNNGGGFSSAILSVLGGSLIGGGFVAYALGSQFEKEKSVSDLSIARLEDLDSPEYCDKETFAKALVELKDVLENDPENFTVAKDDLDAHSDTYFNSHHAEANQRPEIVLYPRNTEDVSKLLKICHKYSIPVIPFSGGTSLEGHFLPTRPGSCVVLDISKYLNKIIQLNKEDLDVVVQGGVPWEELNEYLNDHGLLFGCDPGPGAQIAGCIANSCSGTNAYRYGTMKENVVNITMCMADGTIVKTKRRPRKSSAGYNLNGLIIGSEGTLGIVTEATIKCHVRSTFETVAVVPFPTVSDAASCSSHLIQAGIQLNAMELLDDNMMKIINQSGATSKDNWVESPTLFFKIGGRSEQIIQEVIKEVEKIASQHNNTKFEFATDEDSKLELWEARKVALWSTIDTGRKTNPDANIWTTDVAVPISKFADVINATKEEMNASGLLTSLVGHAGDGNFHAFIIYNTEQRKTAETIVENMVKRAIDAEGTCTGEHGVGIGKRDYLLEEVGEDTVAVMRKLKLALDPKRILNPDKIFKIDPNDHQH

SEQ ID NO: 40 - protein, 582 aa, Kluyveromyces dobzhanskii
MFKFVGRSGTALRSSLQARRNGAVWKRGYASGSGSGSGSGSGSSSLVLGVLAGSMIGGGIVAYTLGNQFEKDKKVSGSSAAAAASDLSILKLEDLESPVYCDSETFSTAVEELKTVLNNDPENFTTAKADLDSHSDTYFNSHHAEPDQRPEIVLFPRNTEDVSQLLKICHKYSIPVIPFSGGTSLEGHFLPTRPGSCVVLDISKYLNKIIHLNKEDLDVVVQGGVPWEDLNDYLIDQGLLFGCDPGPGAQIAGCIANSCSGTNAYRYGTMKENVVNITMCMADGTIIKTKKRPRKSAAGYNLNGLIVGSEGTLGIVTEATIKCHVRSLFETVAVVPFPTVSDAASCSSHLIQAGIQLNAMELLDDNMMKIINQSGATSKIDWVESPTLFFKIGGRTEKSIQDVVDEVEKIASQHNNYKFEFATDADSKLELWEARKVALWSTIDAGKKLDPKVNVWTTDVAVPISRFAEVINATKQEMNSSGLLTSLVGHAGDGNFHAFIIYNSEQRKQAETIVENMVKRAIDAEGTCTGEHGVGIGKRDYLVEELGEDAIAVMRKLKLALDPKRILNPDKIFKIDPNDNQH

SEQ ID NO: 41 - protein, 592 aa, Kluyveromyces marxianus
MLPRFVVRSGAAGRNLGFSFTRKCDHTFLSKTVRNDLSHRPYSTGTNGNGSANAGKSQSGLLFGVFGGTLIGGGLVAYFLGSKFDQQQSSSQQVSDLSIARLEDLDSPKYCDKKTFATAVEELKQVLDNNPENFSDAKSDLDSHSDTYFNSHHATPEQRPEIVLFPRNTEDVSKLLKICHKYSIPVIPFSGGTSLEGHFMPTRPGSCVVLDISKYMNQIIQLNKEDLDVVVQGGVPWEDLNDYLNDHGLLFGCDPGPGAQIAGCIANSCSGTNAYRYGTMKENVVNITMCLADGTIIKTKRRPRKSSAGYNLNGLIIGSEGTLGIVTEATIKCHVRSNFETVAVVPFPSVADAASCSSHLIQAGIQLNAMELLDDNMMKIINKSGATSRTNWVESPTLFFKIGGRSEKAIKEVVKEVEKIASQHNNSNFEFASDEETKLELWEARKVALWSTIDAGKKLDPNVNVWTTDVAVPISKFAQVINDTKEEMNASGLLTSLVGHAGDGNFHAFIIYNAEQRKTAETIVENMVKRAIDAEGTCTGEHGVGIGKREFLVEELGEDTIAVMRKLKLALDPKRILNPDKVFKIDPNDHQH

SEQ ID NO: 42 - protein, 1211 aa, Saccharomyces cerevisiae
MKRIRSLWFNAEASYSNLNNSPSLRNKNSTGNNSRSKNYRSFSRFDLINSILLLMMLFLLAIFVTALYLTKSSRLTYSHASRAALFNPLGVISPSLGNHTLNYDPEARESSKKLYELLSDFNTAYYDDENMILGSNLFSKNTYSRQPYVANGYIGSRIPNIGFGYALDTLNFYTDAPGALNNGWPLRNHRFAGAFVSDFYCLQPKLNSTNFPELDDVGYSTVISSIPQWTNLQFSLVNDSKWFNPQNVTLDDVTNYSQNLSMKDGIVTTELDWLNSQIHVKSEIWAHRHIHPLGVVSLEISLNTDHLPSDFDSLDVNIWDILDFNTSHRTVLHSTGTDEKNNAVFMIVQPDNVPSSNCAIYSTCTVKYENSTNPINSSESFEEKDVSSNIYNVILTEDQPKIIVHKYVGIMSTEFNKNKEQQDNTNIGLAKMIALNSKGNYEKLLSSHKRAWYDLYNDAFIEIPSDSLLEMTARSSLFHLLANTRDYNVSSDRGLPVGVSGLSSDSYGGMVFWDADIWMEPALLPFFPNVAQNMNNYRNATHSQAKLNAEKYGYPGAIYPWTSGKYANCTSTGPCVDYEYHINVDVAMASFSIYLNGHEGIDDEYLRYTTWPIIKNAAQFFTAYVKYNSSLGLYETYNLTDPDEFANHINNGAFTNAGIKTLLKWATDIGNHLGEVVDPKWSEISKDIYIPRSSSNITLEYSGMNSSVEIKQADVTLMVYPLGYINDESILNNAIKDLYYYSERQSASGPAMTYPVFVAAAAGLLNHGSSSQSYLYKSVLPYLRAPFAQFSEQSDDNFLTNGLTQPAFPFLTANGGFLQSILFGLTGIRYSYEVDPDTKKINRLLRFNPIELPLLPGGIAIRNFKYMNQVLDIIIDDHNGTIVHKSGDVPIHIKIPNRSLIHDQDINFYNGSENERKPNLERRDVDRVGDPMRMDRYGTYYLLKPKQELTVQLFKPGLNARNNIAENKQITNLTAGVPGDVAFSALDGNNYTHWQPLDKIHRAKLLIDLGEYNEKEITKGMILWGQRPAKNISISILPHSEKVENLFANVTEIMQNSGNDQLLNETIGQLLDNAGIPVENVIDFDGIEQEDDESLDDVQALLHWKKEDLAKLIEQIPRLNFLKRKFVKILDNVPVSPSEPYYEASRNQSLIEILPSNRTTFTIDYDKLQVGDKGNTDWRKTRYIVVAVQGVYDDYDDDNKGATIKEIVLND

SEQ ID NO: 43 - protein, 1186 aa, Torulaspora delbrueckii
MSGRQRLLESSVATDPSNTRRSKTSALWFWVLIASMVALTTVNFFLANIASFVSGLANLHEPQVGAIKPTVTHHTLDCNENARKSSKKLYELLYDFEASLYDDENMILGSTKFYPNTYSKQPYVSNGYIGSRIPNIGFGYAEDTLNLWTGSGDEIPGALNNGWPLRNRRYAGAFVSDFYCLQESLNSTNFPELDEKGYTTVISSIPQWTNLQFTIDDDSVWFNPQNVSLDEVSNYNQNMSMRNGVVTTQLDWLDGMINVRSEIVTHKKHYALGMMSLEISLNLDRLPPEVPYMDVNVYDVLDFSTSHRTVLQSLGFDKENQGIFMIVEPENVPYSNAAVFSSSTADDSANFTWSEEYSTDEKIVQSTHANLTRENPKIAVKKYVGIMSTEFNTNSAHNVSNIEFAKSVSSRSRGRYDELMSTNTKAWAAIYNDAFIEIPSDALLEMTARSSLYHLLANTRTFNVSADRGLPVPVSGLSSDSYGGMVFWDADIWMQPALLPFFPDIAKNMNNYRNASHQQARLNAQENGYPGAVYPWTSGRYANCTSTGPCIDYEYHINVDVALASFSIYMNGGKGVDDDYLRYTTWPMVRDAAEFFTVYVKFNETLGKYETYNLTDPDEFANHVNNGAFTNAGIKTLLKWATDIGYHLGEYVDPKWIDIAKKIYIPRSCSNITLEYSGMNSSVEIKQADVPLMVYPLGYITDESILNGAIKDLYYYSERQSASGPAMTYPVFVAAAAGLLNHGSSSQSYLYKSVLPYLRAPFAQFSEQSDDNFLTNGLTQPAFPFLTANGGFLQSILFGLTGLRYSYEVDSSTKKISRLLKFNPVELPLLPGGIAIRNFKYMNQVLDVIIDDNNGTIVHKSGDQPIRVKVPDRSYIRDQDISFYLGGNSSGHDDCFNNFIEGGEGDRPVSAFGTYYTINPGEELVLPLFKPGLNVEGNIAESKQVTNCTAGVPGDVPFSALDGNNYTHWQPAYKYDEGKLLIDLGEDNLQEIKSGMILWGQRPARNMSISILPHTYEVEKFVSNLTQVLEHSDLQKIEGEDASEVLEDVGIDTNELRNFECDDDIRTMLNWKTETLESLVDHLKKSKMISRHFVKILDNYSIEPSEPYFKEVYNKSLIEILPSNKTEFSIDYDALKLNDTACYSNDSIQNSTAWRKTRFILVSIQGSYDDDIDIKGGTIKEIVLKV

SEQ ID NO: 44 - protein, 1245 aa, Kazachstania naganishii
MAQYKWNPFSWKYSTLENKKESNTQYLEHSSGREENIPLNPNTSYKLNKLRSISSGETLNSNDRSNISSKRKQQISIGFLGVMLAAILVSMVMVLVTTTNMIMASPFCKRFHGVTTTAEPSREHIDFRQGVIQPAGETHELPYNAEARRASKKLYELLSDFDTAFYDSENMILGTTLFTENVYSRQPHVANGYIGNRVPNIGFGFAYDALNFWSNASGALDNGWPLRNQRFAGSFLSDFYCLEPKLNSTNFPELDDKGYPTVISSIPEWSNLQFSLNGSWFNTSSVHNEDVLNYNQNVSMKDGIVTTEMDWYNGMVHVRSEIWAHRRIHPLAVMSLEVTLNEEHLPDDFDQLDIDIHDILDHATSMRTVLQDLQVDDKNSAIYMIVQPDNVPDSNAAIYSTCIVADSHNVAQNNFEFGINSKEAGKVSQISRNILSRENPSITVTKHVGMMSTEFKTEEHFLHLSNLDVARNIALNAKGQYESLLSSHKRAWYDLYNDAFIEIPSDALLEMTARSSLYQLLANTRTYNVSERGLPVGVGGLSSDSYGGMVFWDADIWMAPALLPFFPEVSKNMNNYRNSTHKQAQLNAQEAGYPGAVYPWTSGRFANCTSTGPCIDYEYHINVDVALASFSIYLNGAAGIDDDYLRYTTWPMVRDAAQFFTSFVKYNATFDRYETHNLTDPDEFADHIDNGAFTNAGIKTLLKWATDIGNHLEEKVDPKWPEISEKIYIPRSPSNITLEYSGMNSSVEIKQADVTLMVYPLGYINDESILMNAIKDLYYYSERQSASGPAMTYPVFVAAAAGLLNHGSSSQSYLYKSVLPYLRQPFAQFSEQSDDNFLTNGLTQPAFPFLTANGGFLQSILFGLTGIRYSYDTDPETKKMSRVMRFNPIQLPLMPGGLAIRNFKYLNQVLDIIIDDNNGTIVHKSGDQPITILVPNRDLIHDRDINVYRRNSSYAKRDLFSREEMQIEKSQQKNVSGTYYTLHPNEELVLPLFKPGLNIENNVAENQQITNLTAGVPGDVAFSVLDGNNYTHWQPLTKASVGKLLIDLGRNNEKDLRHGTILWGQRPAKNVSISILPHNELIEEIFSNVTYILENSQDKDPKKTIEELVGNYVHVNPDNKDCVSDVLTILNWKMDNVDEVIKQMPDIGLIHETFVTIVDNLEIEPNEPYYDELIRNSQIELLPSNMTVFDIDYSKADFSNTLKCFNSGNEQDMIKARYIVVSVQGTYDEDEDTKGATIKEVAFGV

SEQ ID NO: 45 - protein, 1386 aa, Tetrapisispora blattae
MENTRRTDMPSDRDISNIQSGDDKSNIEMLDLHHCDDLSITDNIQKNDLHEQGATTSQPNRSDDIEANEYTLFDIMDHSEEDNNGDSQENSDDQENDDETAPFTHSGGNNNNNEDDDGDDNNNKKITNKNNTNSIINSNSHFHTWSGIKRSIPSLALFAFLMCCVLILMTSTLLHGSSTSFSTFKKNMFNWRHNNGVANSFLRFNHFNNGPTYNIHNTSHISLSNGNEHVLEYNPQYRKASKKLYELLSDFDTAFYDDNNMVLGTDKFSQENTYSRQPYVSNGYIGARLPNIGFGFSLDTFNPWTPDSKNIPDSLNNGWPLRNRRFTGAYVSDFYSIQKSLNSTNFPELDEKGYSTVISTIPQWTNLQFSIEFNNRIHWFNPQMVKDEDITNYKQNLSMKNGVVTTEMDYLDSLVHIKSDVWTHRRMYPLGVLNVEITLNTEKLNYNNNNNNNNNRNSNDEEYNSDEQVILTVYDTLDMETSFRTFLQTSGIEEDNNAIFMVVHPDNIPYSNAAIYSTCSAHYGNSNGWRTPKKDFAFKKNFSSIGNDDNGEKISQYTKVNLSKYNKKLIINKYSAIISSEFNSNEQKSNLEMAKEIALASKGNYESLLKSHTEAWAELYNDAFIEIPSDSLLEMTARSSLFHILSNTRKYNVSEERGLPVPVGGLSSDSYGGMVFWDADIWMQPAVLPFFPNIAKQMSNYRNATHQQALLNAKEHGHPGALYPWTSGRFANCSSTGPCYDYEYHINVDVAMASFSIYMNGGEGIDDDYLRYTTWPLVRDAAIFFASFVQFNQTIGKYETYNLTDPDEFANFVNNGAFTNAGIKTLLKWATDIGNHLGEFVDPRWMEISHNIYIPRSTSNITLEYSGMNSSVEVKQADVILMVYPLGYLNDESILNNAIRDLYYYSEKQSASGPAMTYPVFVAAAATLLNHGSSSQSYLYKSVLPYLRAPFAQFSEQSDDNFLTNGLTQPAFPFLTANGGFLQSILFGLTGIRYTYEVDQETKQIYRVLRFNPTELPRLPGGIAIRNFKYMNQVLDIIIDDNNGTIVHKSGDTPIMIKIPDRSLIHDRDVEPYRGINKTNNLPVEDINNSIQVDDHVEILQNGSYYILNPKEELKLPLFKLKLNVKGNIVENKQITNLTEGVPGDVAVSALDGNNYTHWQPMDKYRPARLLIDLGKDNQQEIKSGMILWGGRPAKNFSISILPHSDQIERILEKVSDRLESTEGSEKSRTIQELLEDIGDVKDTSMEGCQNSDEDRCTNDLESILQWTLDDLDNILSNLPQLKLLNRKFITILKDHEVIPSEPFFPEIIEQSLIEILPSNKTYFHIDYSKIKIGSNGKSLEDNEEDRKARFIVLTVNGVFDDDNDSKGATIKEIVLKNDDTEFIDI

SEQ ID NO: 46 - protein, 1170 aa, Zygosaccharomyces rouxii
MMKIDLNADAGDDSQVPLRRECQESPKAVRKKVISNIIMSVLAIFGLLLLLGWQTAKGQAVLPAAQGPGIIAKATRSHDLQTNDEVRKASKKLYELLADTEGAYYDPDAMVLGSTIFSPHTYSRQPYVANGYIGSRIPNVGFGYAEDVWNIWANADDKIPGALENGWPLRNRRFAGAFVSDFYCLQESLNSTNFPELDKDGYSTVIASIPQWTQLQFSLNDEKWFDPQSVDSEDVSNYTQELSMKNGVVTTCLDWLDGLLHVETEVLAHKKIYTLGIVSMKVSLNVDRLPEDESSVELNFWDTLDFNTSHRSVLAGKGYDEGLYMVVEPENVPYSNASIFSKCEVDGSKVEFSEFGSHEQKVTQNASVILTRDNPQTTIHKYVGIVSTEYSDGATLSRAKDVAIASHGNYEKLSLAHDEAWKKIYDNAFIEIPSDEVLEMTARSSLYHILANTRTYNVSENRGLPVSVSGLSSDSYGGMVFWDSDFWIQPGILPFFPDIAKNINNYRNATHEQARLNAEQYGYPGALYPWTSGRYANCTSTGPCVDYEYHINVDVCLASFSIYLNGAEGIDDEYLKYTTWPMVHDAAEFFTAFVKYNSTIDRYETHNLTDPDEFANHIDNGAFTNAGIKLLLKWATDIGYHIREPVDPRWMEISEKIYIPQSDSNITLEYSGMNSSVEIKQADVTLMVYPLAFITDESILNNAIKDVYYYSEHQSSSGPAMTYPVFVAAAAGILNHGSSSQSYLYKSLLPYLRAPFAQFSEQSDDNFMTNGKTQPAFPFLTANGGFLQSILFGLTGIRYSYEVEPGTKKIQRILKFNPIELPLLPGGLAIRNFKYLDQVLDIIIDDRNGTIVHKSGDQPIRIKVPDRTKIHDRDITPYRGNGSTGMESFQNEDATHGTSAHYYTINPGEELILPLFHMAPNVEGNLVESKQVTNLTAGVPGDVAISTLDGNNYTHWQPVDKSLPGKLLIDLGANNSQVINRGMILWGQRPAKNFTISILPHTEDMGQVLSNLTTIVESTNVGDESVLEALEDIGGLSPLLSHSGDEDVKNLLSWKAEDVDDIMLGISGESNVIRGKFVPILKDYKVEPNEPYFEEIYSKSIIEILPSNRTEFTIDYDKVQHNSTTCSYKNLSDNCTDWTKTRFIMVSIEGTYDNDTDDKGGTIKEIVLLN

SEQ ID NO: 47 - protein, 1175 aa, Zygosaccharomyces parabailii
MKRDLTRNPSNVSTAAEHHAKEPKDCGIKTRLLGVSMVLFTIFTFFLLLGWPFGGLAPTFSAAESAGIIRKTSDVHTLDFNKEARRASKKLYELLVDIDGAFYDAENMVLGATKFSPHTYSRQPYVANGYIGSRIPNVGAGYAEDTWNIWASAGEELPGALNNGWPLRNHRFAGAFVSDFYCLEKTLNSTNFPELDENGYSTVISSIPQWTNLQFSLNETVWFNPQSVTNDNVTNYRQELSMKNGVVTTHLDCFDEKVHVETQIFAHKKIYPLGIVSMKVALNIDHLIPGQFSIELNFWDILDFNTSHRTVLHDLGYDDGIFMIVEPDNVPYSNASIFSTCTVDRTGVTFDRGETTYEQISQNASVILTKDNPNVTIHKYVGIVSSEYYNGSTLDYAKEIAKSNRGNYEKVSKVHNEAWDALYNDAFIEIPSDEVLEMTTRSSLYHLLANTRTYNVSEARGLPVPVSGLSSDSYGGMVFWDADFWIQPSVLPFFPDIAKNINNYRNATHRQAQLNAQQHGYPGAIYPWTSGRYANCTSTGPCMDYEYHINVDIALASFSIYLNGAQGIDDTYLKYTTWPIVRDAAEFFTDFVKYNHTIGKYETHNLTDPDEFANHINNGAFTNAGIRLLLKWATDIGHHLREPVDPRWMNISENIYIPISESNITLEYSGMNSSVEIKQADVTLMVYPLGYITDELVLNNAIKDLYYYSEHQSPSGPAMTYPVFVASAAGMLNHGSSSQSYLYKSLLPYLRAPFAQFSEQSDDNFLTNGKTQPAFPFLTANGGFLQSVLFGLTGIRYTYEVNPASKKIERVLKFNPIELPLLPGGIAIRNFKYMNQVLDIIIDDHNGTIVHKSGDKSIRIKVPDRSLIRDRDVNPYRGPNSSQEVVNEKGHDVEALGDKSLARKAQYYTLNPGEELILPLFKMKKNVEGNIVESKQITNLTGGVPGDVAFSALDGNNYTHWQPVDKSAPAKLLIDLGQNNSQVIQKGMILWGQRPAKNITISILPHTETVGQILEELTTIAENVNVGEESVMEALEDVGGTDFLLANHGDQDVKDLLSWRADDLEEIVRQLSNDSNVMRGKFVPILENYPVVPTVPYFREIYDKSIIQILPSNITEFTIDYSKIAHNSSRCSYRNSSNNCTDWKKTRFILLGIQGSYDEDLDPKGGTIKEIVLLN

SEQ ID NO: 48 - protein, 1202 aa, Tetrapisispora phaffii
MFFDNVYSQRKEKDLVLLIWFQRIFIIMLLIIFLIFNCFITVQSIHINSFFNNKFLRHFSTRNNKLIYASPIAQSNLSILSVGEEISQVATARKTSKKLYDLLINYEDSYYDDENMVLGTDVITKNTYTRQPYVANGYIGSRIPNIGFGYALDEYSIWNPDVTDNPELFNNGWPLRNRRYAGSFVSDFYSLQKKLNSTNFPEIDDIGYSNVISSIPEWTNIKLTVIDENDRSFNFNPQDISVNDITNYHQNLSMQNGMVTTDLNWLNNTLHINSTMFTHRKLYPLGLLEIDITLNREYLPTDFATYNISVFDILDFNTSHRTFLRDMGPSYDSSKMQGIFMVVEPENVPYTNCVIFSTTEIEQLDITGSVHRNITLDDYVIDGMNSSISQVAKDITLSTEFPKLKIYKYSSIISSNYDGCKNNTYQDNLNEAKHLALNSRGNFQNLADSNTQAWVDLYDNAFIEIPSDSVLELAARSSLFHLMSNARLHNISEDRGLPLPVSGLSSDSYGGLVFWDADVWMQPAILPFFPDVAKNINNYRNATHKQAQLNAKQYGYNGAWYPWTSGGFSNCTSTGPCIDYEYHINVDIALATFSIYMNGADGIDDTYLKYTVWPIVRDAAIAFTEYVQYDKQLDVYETFNLTDPDEFANHVNNGAFTNAGIKILMKWAVDIGNHLEEKVDPIWKAINEKIVIPKTSSNITLEYSGMNSTAEIKQADVPLLVYPLGYITDESILNNAIRDLYYYSEHQAHTGPAMTYPVFVAAAAGLLNHGSSSQSYLYKSILPYLRGPFAQFSEQSDDNFLENGGLHPAYPFLTANGGFLQSILFGLTGIRYSYKVDSDTNKIARLLKFNPIKLKLLPGGLKIRNFKYMGQVLDIIIDDYNGTIIHKSGNKTITIQIPDRSSIRDQDINPYRGKNKTKEDNRILSKRKSNIYELKPNENFTIPLFVTELNAPGNIVESKQITNLTEGVAGDVAMSAVDGNNYTHWQPVNKAETARLLIDLGPGNEQTITGGMFLWGQRPAKNVSISVLPHSQATEQLFQNITYFAEHFEFPNRERTILQLIQEVDNITEPEVCQIFSSDGVCDAGFTQLLNWKSKDIDELIQQFPNTPGIRENFITIVDNLSVLPSEPYYPEYYEQALIEILPSNKTKFSVDYSKVEYYKKSEVFEQSQWPKTRFIIVSIQDTYDKDLDPKGSTIKEIILYS

SEQ ID NO: 49 - protein, 1180 aa, Eremothecium gossypii
MADTASLPPQRDSALGMHGPHGGLYMPVAQGPLQAHASPRLVSVRMVLSSITALALVAVVTVLGTAQPARPTAPLAAADEQFWVAQHRSASKQLYQLVHGSELSFYDEGRDVLGTTELSRNMYSRQPYVANGYIGSRVPNVGFGYAADEENIWTDASVPGALNNGWPLRNPRYAGSFVSDFYSLQARLNSTNFPELDEEGYSTVIASIPEWTDLRVRADGAELGAETVALEDMGGYVQNMSLADGVVTTEYVWRGLSVRATVAAHRSEYPLGLVQLEVALCGDTEPREVEVRDVLNFTTSHRTVLREAGHDEDGIYMRVEPENVPYSEAALYSVFEVRGGEGSVQPERAAAGATVAQWVRVRLTAAQPRVVVRKYVGVVSSEYNTAGGSNLEAARAAALAHYGAFDGALVSHRAAWSALYGNASIEIPSDFLLELAAKSSMFHMLANTRAHNVSATRGLPVPVTGLSSDSYGGMVFWDSDVWMLPGLLPFFPDIAREISNYRNATHAQAVANARHYNYSGALYPWTSGRYANCTSTGPCVDYEYHINIDIAMSSLSIYMNGADGIGEDYLRYTTWPLLRDAALFFTEYVRYNETLDAYTTHNLTDPDEFANFIDNGAFTNAGIKILLRWAIDVGTHLEEPVDTKWQEISDKIHIPTSETNITLEYTGMNATVDIKQADVLLMVYPLGYITDESILNNAIQNLYYYSERQSASGPAMTYPVFAAAAATLLNHGSSSQSYLYKAVVPYLRAPFFQFSEQSDDNFLTNGLTQPAFPFLTANGGYLQSLLFGLTGLRYSYTVNPETKKMERLLKFSPVRMPLLPGGIRINNFKYLGQVLDISIDDHNATIAHKQGNTPIHIKVPDRSILRDRDVPVYKGSALQARDVIPYHELSNSNYFTVNPGETLTLPVYEPELNIQGNIVEGRQITNLTQGVPGDVPISILDGNNYTHWQPFDKSERALLLIDLGSEEEYEITTGKILWGARPAKNFSISILPNSKHITEILTKLTAMMDGRNTDLVSCSKCHAVSSSQHLLGGLANVTDSKGLAAIDGETVDMGIREIFRWNLFDLPTISSIIPEAANISESFVTVLENYQVTPSEPYYEEVVRKSQIVILPSNETDFCIDYAAVPKLNPTYTAVNLSADDTNWRKTRFVIVAVEGSYDDDDDQKGGTIKEIALMVAPKN

SEQ ID NO: 50 - protein, 1215 aa, Eremothecium sinecauda
MRDVITSLFLKPQQRRTGSTCVDIESDPVSNKATDFTVGQEPVISEPRKSTKTLNLMSRMMAALTVVILVVTLLAPFSVGTGRDMILLSPVPESRKVGGGKEGMDAELQDRFRVSQHRSTSKKLYELLRDSEKTFYDEEEQVLGTTVASRNTYSRQPYVANGYIGSRIPNVGFGYALDELSLWTGDSDIPGALDNGWPLRNQRFAGAFVSDFYGLVENINSTNFRELDEEGYTTVISAIPQWTDLRLSVFKDNDDNPYATLSPVELDLSQVSQYTQNLSLQDGIVCTEFNWMNLLHIKTSVIAHRKIFTLGLVEMEVSLLEDVKLGKGGSLHVEIEDMFDFESSRRTFLRDHGYDDEGIYMVVEPENVPYSNASLYSRCDVEGGSEVSDVERYVTNNTVIQSHSVYLDHSSPIVVVQKYVGIVSTEYNEEPISNLARAKEVVQDCFGSFDALLSWHREAWANLYADASIEIPSDFLLELAAKSSLYHLLANTRSQNVSSSRGLPVAVAGLSSDSYGGMVFWDADTWILPGILPFFPDIAKEMANYRNATHFQAIENAQKYNYSGALYPWTSGRFANCTSTGPCVDYEYHINIDIAMSSLSIYMNGADGVDDDYLRYTTWPLIREAANFFTEYVRYNETLDAYTTHNMTDPDEFANFIDNGAFTNAGIKTLYKWATDVGNHLEEEIDPMWSEISEKIHIPTSPTNITLEYTGMNATVDIKQADVMLMVYPLGYITDESILNNAIQNLYYYSERQSASGPAMTFPVFVAAAAALLNHGCSSQSYLYKSVVPYLRSPFLQFSEQSDDNFLTNGLTQPAFPFLTANGGYLQALLFGLTGLRYSYTVNPETKKMERLLKFNPIALPMLPGGIRINNFKYMGQVLDISVGDYNASIYHKYGDVPINIKVPDRSVLRDREIPFPSSSNKVQARDMIDYTELKDSNYHTVYPGEKLVLPVFTPGLNIEKNIAEGKQITNLTRGVPGDVAISMVDGNNYTHWQPFNKSERALMLIDLGSEEDFEITGGKIVWGARPAVNLSLSILPHYENMTAVLDSVIETYQKNASSKLTSVRHKGSSGGVPNGSVHTSPDIIGSTIDMGIREIFNWNLIDFDEISAIAPEVLPKFRNFVTILDDHPVEPTQPFFHDVFNQSQIVILPSNETDFYIDYDKVAELNPGYTAIDFKKNDNTWRKTRFVMVTVEGVYDEDDDPYGATIKEIALMST

SEQ ID NO: 51 - protein, 1133 aa, Lachancea mirantina
MKTEKAKSRLFYSVLTCLLVLGWFTVTSYLQKLKPGLSVFESTRRFSERVRNRRKSSQQLYEQLSDSDDTYYDEVHWCVGTSYFSENTFSRQPYVSNGYIGSRIPNVGLGYALDTLNIWTANSSVPGALDNGWPLRNQRFAGAFVSDFYCLEPKLNSTNFPELDDDGYSTVLSAIPQWTDLQFSVRNGSLKFSAQDVRLEDVTNYHQNLSMQTGVVSTELDWLGFLHVKSSVLAHRSKHSLGIVTLELNVNPGWDVDEVDLELCDCLNYTTARRVALQDIGHDSGGIYMTVNPDNVPYSSASIYSSFELLYDGERSGKSEFRFDDNRTTISQCVSVKLEADGPILKANKFTGIMSTEYGDGRRDQTNLEFARSVVKESLGSCHKLTESNRAAWEALYSDAHIEIPSDSLLELAARSSLYHLLANTRRFNVSAERGLPMPVSGLSSDSYGGMVFWDADIWMMPSLLPFFPEIARHIVNYRNGTHQQAVLNAQKYDYSGALYPWTSGRFANCTSTGPCVDYEYHVNFDIAMASFLMYLNGEGEDYLRYTTWPLVRDAAKFFAEYVQINHTTGQYETFNLTDPDEYANFVNNGAFTNAGIKTLMKWATDIGYHLGNEVDPKWNHISKNIYIPMAESNITLEYSGMNASVEIKQADVVLMTYPLGYITDETILKNAIRNLYYYSERQSASGPAMTYPVFVAASSLLNHGCSSQSYLYKSVLPYLRAPFMQFSEQSDDDFLTNGLTQPSFPFLTGNAGFLQGILFGLTGLRYSYEVDPASKTINRFLKFIPMKLPLLPGGIAIRNFKYMGQVLDVIIDDKNATLIHKQGDLAVTLKTFNRSFNTDRQLGAHHMWTELLAKNESLPATFYTLNPRETLSLPLFEPLLNIDNNLAEGKQITNFTAGVPGDVVYSAVDGNNYTHWQPLNKDMRAKLLIDLGPDNDKPLTRGMILWGKRPARNVSVSVLPSHGKYVKGIKIKKREEDETGFCPLTILRGRCNVASAIALPEDSHIFDTELRDMLNSERLDLEQLTRLSPNYSVFTDRFVTILEDFQVFPSEPYYETLQRNKSIVILPSNKTEFVFDYEELCMRACNDTHVCAENAITGLPPPRFVLLSVEGTYDDDKDPKGATIEEIAFLSD

SEQ ID NO: 52 - protein, 1070 aa, Candida orthopsilosis
MDIENNGIYIEDSSNTEGIKKSLRDNKVYIVSMTLVANIILFYSLHLLNARFCEAFPFVLPRSEKYTLQQSDSNIGDFVNSFANKEIFSQIQFSEHAFYDRELNVVGTIEFSKYNQYQKQPYVANGYIGSRIPNLGQGFTYDQLTNSPDSKKDDLYNGWPLFDKRFSGAFIAGFYDLQENTTGNNFPELLKNGYESVISAVPQWTTLKLVIHRDSKNYTLDPSSPDGIGEITNYVQNMSLSTGIVTTQFTWLDLLDVKYTVLAHRSEINLGLVKVDIQNKGNDTIELDVIDELNFDTAQRCELNSIGHDNSGIYVSFSPLNLDYISGAIYSTLHLDDITRRSNNKQTKQTSSIRLNAQDSTQFGKTVGIASTDLNPSKFENTRDTLQFAKKVSQKFEYLDLIIKSHVQAWKEVTGKAPSLSFPNDPLLDLGSKASVYHLLANTRADAQGLTGALGVAGLSSDSYGGMVFWDTDFWMFKAILALNPSHAKSIVNYRVHTHEQALKNTPSGHEGAAYPWTSGRFGNCTATGPCLNYEYHINSAIAMAAWELYLSGAVDDQYLESTVYPLINDAAKFYADYVTSYNDTIDKFVTNNLTDPDEYANHVDNGAYTNAGIALLMKWINDIGDVLNVKMPEIYTEISQKMYLPTANNSQNITLEYSGMNSSVGIKQADVVLLTYPLQNSLVDDEQAYTNMEFYSGKQVSYGPAMTFSIFSIVAANLASSGCASQSYLHKAMQPYLRGPFAQFSEQNNDDYKSNGGTHPAFPFLTAHGGFVQAVIHGLAGLRHSYAIDDGKISRSLFLDPIALPCLGNGVQYSGIHYDNHTISMNITESTFTIKNEGKTNNRANDYISITIADRNPGRGTYKLNDNEEKSFKLYQPNKNFEDSISECGLATFYNITESAPGDSSFSINDGDNTTRWQAKYNDTTGKVLIDLHSIKNITGVIFNWADKPPKKVTLSKYSDTKFKAVTDFLAKVDFGNPVYKNYRFANPDEKLLNQSDAFEEVHSEDVLISAPFSNKEFEKVLVPVRHNTTSWDINLKTRFLLLEVDSIHNTVPIEDDYGGAKIAEVSFF

SEQ ID NO: 53 - protein, 1044 aa, Candida maltosa
MIFFANLFVLFSLHLLYAKFCEGYPNVVPVKIRSTGRIHRPNLEKLVNSPENKQIFSQLKFSDHAFYDTTANTVGTIEFPVFNQYQRQPYVANGYIGSRIPNLGHGFTYDQLTNSSDANDDDLVNGWPLFNKRYAGAFIAGFFDIQKNTTGTNFPELLENGYESVIAAVPQWTSLSLSVTIGGKNYTLDPALEPELIGNITNYVQNLSMSDGIVTTQFTWLNSIDVKYEVLAHRTEINLGLVNLQISNRGQQSIDVIVTDELDFETSKRCQLNKAAFDDQGIYVTFSPHDLDYVHGAIYSTLISSDASPCKSSNETVTSQSLQLSLECNANFEVTKVVGVVSSDLDPNSFKSSDDVLQYAKKISQKYNNVDQIINSHKEGWSEILQHSPLITFPSDPLLNLGARASIFHLLANTRPDAQGVTGALGVGGLSSDSYAGMVFWDADLWMLNGILPFAPAHAKSLVNYRLHTHNQAIENVPEGYNGAVYPWTSGRFGNCTATGPCLDYEYHINMAVSMAAWQLYISGAADDDFLADVAYPLINDAATFFSEYVTHFNNTVDKYVTKNLTDPDEYANHVDNGAYTNAGIALVMKWAQIVGNHLGKDVPNTYKDITEKMFLPTGDNSQNITLEYSGMNSSVGIKQADVIMITYPLENELIDEDQAYTNMEFYSMKQVSYGPAMTFPIFSIVAANLAPTGCASQSYLQKAIQPFLRGPFAQFSEQNNDNFLTNGGTHPAFPFLTAHGGFLQATLQGLTGMRYGFTVDEQASKLVRVLNLDPIALPCLGDGVQFDGIKYDNHTISMSINQTHFTIKNTGKTDSNGGNSFITISLAERNPDHGQYTINDNEEKSFALFKPDTSFIDSISECGQADFYNITESAFGDSPISINDGDNTTRWQVKYNDTVGKILVDFKSFKNISGVTFNWADKPPKNLKLSKYSGDQFTTVTDFFAKVDFGNELYDSYKYANPEDKIYNQSEVFQEIHSDSVEISAPFDNDEFSQVLVPTRHNTTILDLELSGRFLLIEVDAIHNTVPIDGDFGGAKLAEVVFY

SEQ ID NO: 54 - protein, 1083 aa, Candida tropicalis
MGRKPSSIIPEEEVDEDEEDSKLLFLLNFLKSLPIKKIWIVMIVFANLFVFISFQLFYAKFAHGFPGVIPLKARSPEGLHTVDLSKLIDSQENKKIFSQMKFSDQAFYDTTDNVVGTTEFTEFNQYQRQPYVANGYIGSRIPNIGQGFAYDQLSNSSEANEDDLSNGWPLFNKRYAGAFIAGFYDIQKNTTGTNFPELLENGYESVIAAVPQWTSLSLSVEIDGQVYILDPALDSQDMGGISNYVQNLSLSDGIVSTQFTWLNKLNVKYEVLAHRTNINLGLVDLQISNIGNENLELTVTDSLDFNTSQRCQLNDVSTDDQGISITFSPHDLDYIHGAIYSKLVLDGEITREVQTYEKVTQSSKITIGCNSNIKISKFVGVASSDLQPDQLKTSDDVLQLAKSVAQECHNAEQIIDSHKQAWSEVINNGPLVTFPSDPLLNLGARASVFHLLANTRPDAQGVTGALGVGGLSSDSYAGMVFWDADLWMLNGILPFAPSHAKSLINYRLHTRQQAIENVPEGYQGAVYPWTSGRFGNCTATGPCLDYEYHINMAVAMAAWQLYISGAADDLYLETIAYPIIYDAANFFSDYVVNFNDSLNKYTTSNLTDPDEYANHVDNGAYTNAGIALVMRWAQVIGGHLGKVVPQLFQDIEQNIFLPTANNSQNITLEYSGMNSSVGIKQADVIMMTYPLENELIDDEQAYINMEFYSMKQVSYGPAMTFPIFSVVAANLAPTGCASQSYLQKAIQPFLRGPFAQFSEQNNDNYLTNGGTHPAFPFLTAHGGFLQATLQGLTGLRYDYDIDENGKLVRILRLDPIGLPCLEEGVSFNGIQYDNHTISMSINQTHFTITNKCKTNPNANDHITILLAERNPDNGQYVINDGETKSFALFKPDISFPDSISECGQASFYNVTEGAFGDASISINDGDNTTRWQVKYNDTVGKVIVDFKSFKNISGVTFNWADKPPINVKLSKYSGDQFTSIVDFFAKVDFGNELYNSYKYANPEDHIFNQSEVFEEIHSESVTISAPFDNKEYTQVLVPTRHNTTSIDLNLSTRFLLIEVDNIHNTVPIDDDYGGAKLAEVVFY

SEQ ID NO: 55 - protein, 1078 aa, Candida albicans
MAANSSFFLADNCAPHNQSFIQFCIHAASKKKGWIALMCLANLFLLFSFHLLYARFCSGFPYVVPSTARSTNQIFHTNLEQLVNSPENKQIFSQLKFSDQAFYDPHDNVVGTTEFPVFNQYQRQPYVANGYIGSRIPNLGQGFTYDQLTNSSTANDDDLLNGWPLFNKRYSGAFVAGFYDLQKNTTGTNFAELLENGYESVIAAVPQWTALSLSVEILGKKYTLDPSLEHEAIGDITNYVQNMSLSDGIVTTQFTWLNTFDVKYEILAHRENINLGLVNMQVYNPGNESVQVIVSDVLDFNSSQRCQLNQISHDKNGIYVTFHPQGLSYIDGAIYSTLSANGQITREQTNETVFQNVELTIEPHSCVQVAKYVGIATTDLDPDSFKTADDVLKFARKVSQNKKHGDATQLVNSHRSAWSKIIQDAPLVTFPSDSLLNLGARASIFHLLANTRPNAEGVTGALGVSGLSSDSYGGMVFWDTDLWMLNGILPFAPDHIKSFINYRVHLHQQAIDNVPRGYQGAVYPWTSGRFGNCTGTGPCLDYEYHINMAVAMASWQLYISGAADDTFLESVAYPIINDAASFLAEYVVHYNDTLGKYTTKNLTDPDEFANHVDNGAYTNTGIVLVMRWAQTAGSILGKQVPKIYHDIETAMFLPTAENTQNITLEYSGMNSSVGIKQADVIMMTYPLENELIDQDQAYINMEFYSMKQVGYGPAMTFPIFSIVASNLAFTGCASQSYLHKAIQPFLRGPFAQFAEQNNDDYLTNGGTHPAFPFLTAHGGFLQAILQGLTGMRFDYTFDNNKLQRLLKLDPIALPCLGEGVRFDSIKYDNHTLSMAINETHFTIKNKGKTTPNARNYVTILLAERNAMHGKYTINDEDEQSFPLFETSESFPDSISECNKAGFFNITEGAYGDVSISINDGDNTTSWQAKYNDTTGKVLVDLKSFRNISSGTFIWGDKPPKRVKVSKYSGSSFTAVTDFFAQVDFGNELFNEYKYANPEGKLHNQSDVFEEVYSGDVKISAPFDPEEYFQVWVPTRHNITEVAVNLQTRFLLIEVDEIHNTEAIDGDYGGAKLAEVVFY

SEQ ID NO: 56 - protein, 1140 aa, Lodderomyces elongisporus
MVSNEEDIYINHDPNPNFNSDSNSNSNSDPDPNYNFISRFTSTPSINSDSHLGSHPNSTFQLYLNRAKGKSSMIIMALIANFILFYSLHLLNVRFCEAFPYLVPEVEKESVFNNIFSSLEGLEDLVNSYENKDIFSQLKYSGQAFYDNELNVVGTLEFPLYNKYQRQPYVANGYIGSRIPNLGHGFTYDQLPDTCQYCEDDLSNGWPLFNKRFAGAFIAGFYDLQENTTGTNFPELLENGYESVIAAVPQWTTLNVAIEANGQNYTLDPSLETHEIGNITNYVQNMSLSNGIVTTQYTWLHNIDIKYTVVAHRAQPNLGLVTLDIQSRSDEVVNLRVEDILDFNTSQRCELTALGHDELGIYITFQPENVDSAHGAIYSRLIESLESAGATGASAVSNLEKVSDGERISQIAKITLEPFESTQINKVVGIVSSDSDPENLGTAKSVRESAKEAAQKYNNIQDILTTHNDAWTKLLGENPRVTFPSEPLLNLAARASVYHLLANTRPQAFGLTGAVGVGGLSSDSYAGMVFWDTDLWMFNGILPLMPSHAKSIVNYRLHLHEQAVQNVPEGYNGAVYPWTSGRYGNCTATGPCLNYEYHINTAVAMAAWELYISGASDELFLREYASTLINNAATFFSDYLVQWNDTLGQYTTSNLTDPDEYANHVDNGAYTNSGISLLMQWATMVGHILGEDVPDVYSQIAENLHIPSANNSQNITLEYSGMNSTVGIKQADVIMMTYPLANNLIDEEQGYINMEYYSMRQVSYGPAMTFPIFSIVASKLAVSGCASQSYLHKAVQPYLRGPFAQFSEQNNDDYKTNGGTHPAFPFLTAHGGFLQAALHGLTGMRHRLNVSDTGVIERFLFLDPIALPCLGEGVLFNSVFYNNHTISMSINQTHFTIENNGKTSDSQNADGFITLQLAERNPDHGTFVLLDGEKRSFALYKPEKSFVDSISECGDASFYNITEGAYGVTPISINDGDNTTRWQAKTNDTVGKILVDLHSIKNVSSVLFNCADRPPLSLKVSKYIGDKFTQVTDFLSQVDFGNEVYKNYRYANPNDKLYNQSEVFEEVSSQDVSISEPFSQEEFDQVLVPVRHNATLLDLEIQQCRFILIEVEGVHDNSSLEEDGDESYSDGAKLAEVAFF

SEQ ID NO: 57 - protein, 1078 aa, Candida dubliniensis
MAANPSFILVDTRRPHNQSFIQFCIHATSEKKSWIALMCLANLLLLFSFHLLYARLCNGFPYVVPSTARSTNPIHYTNLEQLVNSPENKQIFNQLKFSDQAFYDPHNNVVGTIEFPLFNQYQRQPYVTNGYIGSRIPNLGQGFTYDQLTNSSTANDDDLLNGWPLFNKRYSGAFVAGFYDLQKNTTGTNFAELLENGYESVIAAVPQWTALSLNVELLGKKYTLDPSLEHEVIGNISNYVQNMSLSDGIVTTQFTWLNSIDVKYEVLAHRENINLGLVNMQIYNSGNESVQVVVSDVLDFSSSQRCQLNKVAHDKNGIYVTFNPQGLSYIDGAIYSTLSVDGDITREQINETVSQKAKLTMEPHSCVQAAKFIGIATTDFDPDSFKNADDVLKFAREVSQNKNHGDASQLISSHRSAWSKIIQDTPLITFPSDPLLNLGARASIFHLLANTRPNAEGVTGALGVSGLSSDSYGGMVFWDTDLWMLNGILPFAPDHIKSFINYRVHLHQQAIDNVPSGYQGAVYPWTSGRFGNCTGTGPCLDYEYHINMAVAMASWQLYVSGAADDTFLESVAYPIINDAASFLAEYVVHYNDTLGKYTTKNLTDPDEFANHVDNGAYTNTGIVLVMRWAQMVGRILGKEVPRVFHDIETAMFLPTAENSQNITLEYSGMNSSVGIKQADVIMMTYPLENELIDKDQAYINMEFYSMKQVGYGPAMTFPIFSIVAANLAFTGCASQSYLHKAIQPFLRGPFAQFAEQNNDNYLTNGGTHPAFPFLTAHGGFLQAILQGITGMRFDYTFEDNRLQRILTLDPIALPCLGGGVRFDGIKFDNHTLSMAINETHFAIRNNGKATPNAQNHVTILLAERNPMHGKYTINDKDELSFPLFETSESFPDSVSECSKAGFFNITEGAYGDVSISINDGDNTTSWQTKYNDTTGKVLVDLKSLKNISSGTFIWGDKPPKRLKISKYSGDGFATVTDFFAQVDFGNKLFNEYKYTNPEGKLHNQSDVFEEVYSGDVKISAPFDPEEYFQVWVPTRHNITELTLNLQTRFLLIEVDEIHNTEPIDGDYGGAKLAEVVFY

SEQ ID NO: 58 - protein, 1094 aa, Spathaspora passalidarum
MVRKKTQYQSLNIAPGPGETNNPTFFEYLFSSIRHHKGIVTMVIFANLITLVSIHLLFLKYANAFPHIARNQDEFGTIKNNPSKDQQSPFSDQSGLINLINSPQNKAIYSQMKYSSYAFYDNTTNTVGTIEYVPFNQYQRQPYVANGYIGSRIPNLGHGFTYDQLSDAPDANDDDLLNGWPLFNQRYAGAFIAGFFDIQKNTSGTNFPELLDNGYESVIAAVPQWTTLKLSTTKDNQNYTLDPSLPPAQIGSISNYVQNLSLSNGIVTTQYTWLDSIEVKYEILAHRHNIHLGVVNLEVYNSGNETVRLDITDEIDFNSAQRSQLTGVNTDDKGIYVTFQPSEIDYVNGAIYSTLIVDSPITRQTTNGTTAQQIATIYLQPHESLSANKFVGIASSDLNPDQLTTTDSVLNIAKEVSQKHQKLKPVVKSHNEQWKKTLGENPLVTFPDAPLLNLGSRASIYHLIANTRPDAQGVTAALGVGGLSSDSYAGLVFWDADLWMSNALLPFAPDHAKSIVNYRLYTHAQAVKNMPAGYEGAVYPWTSARFGNCTGTGPCLDYEYHINVAVAKAAWNYYLSGAGDEDYLADVAYPIINDAATFFSGYLAQYNESVNRYTTHNLTDPDEYANHVDNGAYTNAGISLVMKWAIALGNHLGKDVPQIFQNIAGNMYIPSANNSQEITLEYSGMNSSVGIKQADVIMMTYPLDNELLDLEQAYENMEFYSMKQVSYGPAMTFPIFSIVAANLAPTGCASQSYLQKAIQPFLRGPFAQFSEQNNDNFLINGGTHPAFPFLTAHGGFTQAVLQGLTGMRYDYFIQNGTLVRALRVDPIALPCLGSGVQYEGIYYNNHSVAMSINETHFTIQNRGPTEKSAGKYINIIVDDRNPKQGQYALDDYDEMVIPLYTPIASYPDSISECGLASFYNITEGAYGDLPISINDGDNTTRWQVKNNDTIGKILVDLKSFKNISNILFNWRDKPPQTLRLSVYNDNQFTDATDFFSKVDFGNGLYNDYKYHNPDSQIVNQSDVFTEVYSASVDITAPYDSNEFNEVMVPDRSNITSLNLNLYNRFLLIEVNGIHDAEPVEGDTGGAKLAEVTFF

SEQ ID NO: 59 - protein, 1083 aa, Scheffersomyces stipitis
MVVVSKWRFSDVIHTVCDTIVDTFYRKQAFVKTMVFVNVGLILLLHWYFVSLSQAFPLQLRNHVPGTVTHESVAEERARHLKLVNSPQNKAVYTQLKYAANAFFDVDTNTIGTTHFTPYNQYQRQPYVANGYIGARIPNLGQGFTYDQISDSADATNDDLLNGWPLFNERYSGAFVAGFFDIQKNTTGTNFPELLANGYESVIASVPQWTTLQVSTIKDGVDFSLDPVNSVDMNNVISSYGQNLSLVNGIVTTEYTWLDDIRIKYKILAHRKEINLGLVELSISNMGNTSLTFNVTDVLDASTAQRSQLTGVNSDGKGIYITFSPNELNYINGAIYSTLHVEDGSSIQSSSSTSKVSQYVEVTVNPGRTSRVVKLVGVATTDLDPRNLDSLDKVLAFAKKVSQTYTNADDVVESHLVAWAQTLESTPAITFADDRLLTLASRASLFHLTANTRPDANGVTAAMGVAGLSSDSYAGMVFWDADIWMMSGLLPFIPSHAKSIVNYRMHTHDQAIKNLPEGAKGAVYPWTSGRFGNCTATGPCLDYEYHINVAVAMSAWQLYLSGAADEQFLADVVYPLVNDAAEFFADYVVTYDDTLKQFTTHNLTDPDEYANHVDNGAYTNSGISLVEKWAIQISNHLGKEFPSQYSNIVGNMHLPTSGNSDNITLEYTGMNSSVGIKQADVIMITYPLQNELISEAQALTNMEFYSVKQVNYGPAMTFPIFSIVASHVSTSGCASQSYLQKAVQPFLRGPFAQFSEQNNDDFLTNGGTHPAFPFMTAHGGFLQAVTQGLTGLRFGYVIEDGQIKRALDLDPTALPCLPNGVIFDGIKYNNHSLSFAVNETSFTVKNNGPISEKSDGVVRIRIADRNPSRGIYTINSGEDFSFPLYTPKPSYPTSISECGLASFYNITDGAYGDSPISINDGDNTTQWQAKYNDTTGKILVDFKQFKNVSNGIINWGDKPPKNWKLSQFTGSLVEFKDVEDVLSQVDFGNELYNIYRYEDEDYKLYKQDEVFQVVLSSNVSISAPFILEDYNTIELPKRQNTTEFTIDEELYSQFLLIEIEGIHNTVPIEDDTGGAKLYEVVFF

SEQ ID NO: 60 - protein, 1101 aa, Debaryomyces fabryi
MEYDSLGERFKHRAISKVDHCNHFIHKFCKRQIVIKTMIVLNFILLFVLYLYHQGITYALPFAIKDVNIDDSFNDSTVTFETIESNRKQLQKLINSRENKEIFLQLQNSGSAYYDPTTNTVGTAEFPTYNQYQRQAYVSNGYIGSRIPNLGQGFTFDQLSDSPDAVEDDLSNGWPLFNERFSGSFIGGFYDIQKNTTETNFPELIKKGYESILSAVPQWTTLTLSTVKNGKTFSLDPSLSRDAQGDISNYAQNLSLSNGIVTTEFTWLDSLQVHIEVVAHRSNINLGIVNLRIVNLGNSTVDLKVEDKLEFASTQRCQLTEVGHDDEGIFIHFQPNEIDYVNGAIYSTLKYDEKSLNSISRDSKNDTSTQELDISVEPSKSFKISKMVGIVSSDLDPEKYKTSSSVNDFAKQVATKQADSVSDLIKSHKTEWDRTFESSNSITFPGDSLLTLASRASIYHLNANTRPGARGVTAALPVGGLSSDSYGGMVFWDTDLWMLNGLLPFNPDHAKSIVNYRIHTHEQAKKNVPDNKGGAVYSWTSGRFGNCTSTGPCMDYEYHINIAVAMAAWEVYLSGAADDDYLDSVAYPLINDAATFLANYVEYNDSLAQYVTHNMTDPDEYANHVDNAAYTNAGISLLMKWAITISNHLGKSVPTKYTDIAGSMHIPTSDNADNITLEYSGMNSSVGIKQADVIMMTYPLGNELISDDQAYTNMEFYSMKQVSYGPAMTFPIFSIVASNLSPSGCASQSYLHKAVQPFLRGPFAQFSEQNNDNFLTNGGTHPAFPFMTAHGGFLQAILQGLTGLRFDYNIDDTNKLSRMLTLDPISLPCLGNGVQFDSIKYMNKTLSLAINETSFIVKNNGPITGSKDDSPIKISLAKRNPKAGVYTLKKGEELVFPLFEPEAGSPLSVSECASAKFINITESAYGDATVLVNDGDNTTHWQLKYNDTTAKLLVDLKQPRNITSGVINWGDRPPKSWSLLAYGSHEQSKIKDLNDNIDFLSKVNFGNNLYKKYEFMDVDMVYDQDDVFTTIISESVDISAPYDPKESAQIEIPLRHNTTSFAVEQGLNARFLLIEVTDIHDTEPIDDETGGAKLYEVEFFE

SEQ ID NO: 61 - protein, 1049 aa, Candida tanzawaensis
MMIVANLAFLLVLQLTWDVLWAHPLTVPKLFAASNLSADTVHTDRDALFALINSTANKQVFSQLKYSSSAYYDLDANIVGSAEFAPNNQYQRQPYVANGYIGARIPNLGQGFTYDQLSTDADATDADLLNGWPLYNKRYAGAFIAGFYDIQANTTETNFPELEKNGYESIIAAVPQWTALELSTTVDGVNYTLNPALESHLQGSISNYAQNLSLSDGIVSTEFTWLDSVQVKIEILAHRHHVNLGVVHLELANIGSSALDIKVRDVLDFATAQRSQLASVDHDQDGIYITFQPNEIDYVNGAIYSTLLSDHPPNFEQATNGTVAQSLDIQLQPGSTFKVTKYAGIVSSDLDPANLKSEKDVLSLARRVSQSFTDIKEVFETHKTAWAQTLESTPAVTFPNDLLLTIAARASIYHLAANTRTDAEGVTAALPVVGLSSDSYGGMVFWDTDLWMFNGLLPFLPSHAKSLINYRIHTHEQAKKNVPAGYEGAAYPWTSGRFGNCTSTGPCVDYEYHINMAVASSAWNLYLSGEVGEDFLESVAYPLIKDAATFFSEYVVKLDESTGKYVTHNLTDPDEYANHVDNGAYTNAGISLVMKWAIDVSNHLGKEVPSQFMDISDNVLMPTSNNSDQITLEYSGMNATVGIKQADVIMVNYPLENELITPEQALKNMEFYSKKQVSYGPAMTFPIFSIVASNVSPSGCASQSYLRKAVQPFLRGPFAQFSEQNNDDFLTNGGTHPAFPFMTAHGGFLQAIMQGLTGLRYDFAVKHNKIQRVLKLDPIAIPCLGGGVFYDGIHFDNHTLTMSINETYFTVKNNGPANEFASESIEIRVGERNKEAGQHTLKNGETLTIPIFTPGESYKASITECALSDFVNITAGAYGDATVLMNDGDNTTNWQVASNTSVGKVLIDLKEYKNVTKGFFNWGDKPPKQVKLSAYNSLHDLQNTTAFLSKIDFGNEVYTNYAYANPSGELIKQEEVFESFLEESVDVTVPFTMDDFLSLTVPVVFNTTTFELPNPVFTRFVLLELQGIHDTEPIDLDTSGAKVYEAVLY

SEQ ID NO: 62 - protein, 1147 aa, Kluyveromyces dobzhanskii
MMLILPLLLFSVTILAPVYFYLSKPMPLQHPLFGSIVCVDEELYCPESKRKASEKMYSLLKDSDHTFYDEEQQVLGNLLPSENTFSRQPYVANGYIGSRIPNLGFGYALDTMNVWVNDSSIPGALDNGWPLRNRRFAGAFVSDFYCLQEKLNSTNFPELDDNGYSTVISTIPQWTDLSIIRHTDLGEVEYINPTDVNLDKISNYMQNLSLQDGIVTTSFVYDNSLLVTTKVIAHRKIYPLGIVTLELSSVGNNEFSDGLHSKSVELEICDTLNFSTSHRTVLADHGYDRKNNGIFMVVEPENVPYSNASLFSYFDIASRDNLTFTKSPNSINQCTKHVLTPNTTFVAHKYVGIISSEYDNQASTVVTNKTDDNLYEMSNLERAISIVSSNQGNYESLIQLHRETWEKIYKDASIEIPSDRLLEMTARSSIYHLLANTRSHNISKDRGLPLGVSGLSSDSYGGMVFWDSDLWILPSLLPFFPETAKQINNYRNASLSQAKLNAQQYGYEGAVYPWTSGRFANCTSTGPCVDYEYHINVDIALSSFAIYMNGGVDDEESEEYLRYTTWPFVENAAKLFTQYVKWNDSMQQYTTHNLTDPDEFANFIDNAAFTNAGIQTIMVWATDIARHLGIEPDPKWLNIADNIHIPISDSNITLEYSGMNSSIDIKQADVVLMIYPLSYITDQSILNNAIKNLYYYSERQSASGPAMTYPVFVAGAASLLNHGCSSQSYLYKSVVPYLRSPFAQFSEQSDDNFLTNGLTQPAFPFLTANGGFLQSILFGLTGLRYSYEFDEEAEKINRLLKFNPIQLPLLPGGIRINNFKYMGQVLDVLITDTEGIIIHKKGNKDIKIKVPDRALIPDIEIENPSEADPIKQIMHGRRSSHNNKNYFTIKPGDVFKTPLYIPKKNIEGNLVEAKQITNLTEGVPGDVAVSILDGNNFTHWQPAYKKLPAKLLIDLGNNTEDDIVAGKILWGSRPAKSFSLSILPQTEEIAQNLTHILSNVNQYCNESSDTCERKLQNPKEDFDAAIIDIFDWYGIDLDAIRKKHPELGEIKTKFVKLLDNYTVTPSEPYPWRVYNESKIVLLPGNETDFTIDYSKVPDLNKDNEDIDFRSDETNWKKPRFIVLTVHDTYDNDDNEKGATIKEFALFS

SEQ ID NO: 63 - protein, 1157 aa, Kluyveromyces marxianus
MIIIPLVVLVFTVLAPVYFYVTKPESSTHSLFPELAPARISWPFAGTCASSSGGEEDPLYCPDAYRKASEKMYDLLKDNEYAFYDETSETLGNLLLSENTFSRQPYVANGYIGSRIPNVGFGFAYDAINIWVNDSAIPGALNNGWPLRNQRYAGSFVSDFYSLQEKLNSTNFAELDKDGYSTVISSIPDWTDLSIMIHRGPGENNVEYINPTDVKLDKITDYMQNLSMRDGIVTTKFVYDNNLFVTTRTLAHRSIYPLGIVDMEIELLPQATENGLHEASVELEICDTFNFTTSHRTVLADFGHDKKNEGIYMIVEPENVPYSNASMFSYFDIPSRDEYTVAKTNDSVSQCTRRVLTTDSRENSTFIVRKFTGIVSSEYDNNNPEHMSNLERATAVVMENKGDYKNLLKMHRDHWKRLYADASIEIPSDGLLEMTAKSSIYHLLANSRSHNVSQSRGLPVPPSGLSSDSYGGMVFWDADVWMLPALLPFFPEIAKQMSAYRNASLAQAKENAKKYGLQGAIFPWTSGRFANCTSTGPCVDYEYHINVDIALSSLYIYMSGEEDEEKSEEYLRYTTWPFIENAAKMFTDYVKWNDTLQQYTTHNLTDPDEFANHVDNGAFTNAGIKSIMGWAHDIANHLGLDPDPKWTEIAEKIHIPISDTNITLEYTGMNSSVDIKQADVVLMTYPLGYFTETSQPRNAIKDIYYYSERQSASGPAMTYPVFVAASASLLNSGSSSQSYLYKSVVPYLRSPFAQFSEQSDDNFLTNGLTQPAFPFLTANGGYLQSILFGLTGLRYSYEVDKDTGKMHRLLKFNPISLPMFPGGIRINNFKYMGQVLDILLTDNEGIIKHKKGNKSILIKIPDRGDIPDVKPDEYTQINGTSVNVKRAVPSGESYHTIEPGTVFKTPLYNPKRNMANNIVESKRATNITVGVPGDVAVSAIDGNNYTHWQPANKKQPGRILIDMGNGTANEIKSGKILWGNRPAKSFSLSILPQFDQITQNMTSVLSQPSSHNCSNDDGWDSNCKYQEEEENIDAAIKDVFEWYGMDLQSVIENYPELSNVSMGFIKLVDHYNVTPSYPWKNVNSTRIELTLGNETNFVVDYSKVPELNLNNNLGVDLQSKDTRWRKPRFVVLTVFDTYDDDDEVKGATIKELSLFDN

SEQ ID NO: 64 - protein, 1169 aa, Zygosaccharomyces rouxii
MMKIDLNADPGDISQTPQEREYRDSSESTWKKFISITMALLAIFGLLLFFGWQTVNGQSVLPAAQGPGIIVKANRDHDLQTNNEVRKASKKLYELLADTEGAYYDADAMVLGSTVFSPHTYSRQPYVANGYIGSRIPNVGFGYAEDVWNIWANADDTVPGALENGWPLRNRRFAGAFVSDFYCLQESLNSTNFPELDKNGYTTVISSIPQWTQLQFSLNNEKWFDPQTVDPKDVANYTQELSMQNGIVTTQLDWLDGLLHVETQVLAHKKIYTLGIVSMKVSLNVDRLPQGESSVELNFRDVLDFNTSHRTVLADKGYDEGIYMVVEPENVPYSNTSMFSKCEIDNDGVKFNEFGSDDETVSQNASVILTKDNPQVTIHKYVGIFSTEYYNGPTLNRAKEVAVTSYGNYDKLTKAHNEAWKNIYDNAFIEIPSDEVLEMTARSSLYHLLANTRTYNVSAEKGLPVPVSGLSSDSYGGMVFWDSDFWIQPGILPFFPDIAKNINNYRNATHEQAQLNAKQYGYPGALYPWTSGRYANCTSTGPCVDYEYHINVDVCLASFSIYLNGAKGIDDDYLRYTTWPMVHDAAEFFTAFVKYNSTIDSYETHNLTDPDEFANHVDNGAFTNAGIKLLLKWATDIGYHLKEPVDPRWMEISEKIHIPQSDSNITLEYSGMNSSVEIKQADVTLMVYPLAFITDESILNNAIKDVYYYSEHQSSTGPAMTYPVFVAAAAGILNHGSSSQSYLYKSLLPYLRAPFAQFSEQSDDNFLTNGKTQPAFPFLTANGGFLQSILFGLTGLRYSYEVEPGSKKIQRILKFNPIELPLLPGGIAIRNFKYLGQVLDIIIDDRNGTIVHKSGDQPIRIKVPDRTLIHDRDITPYHGNGSAGMESIKIDNTTHGTSAHYYTINPGEELILPLFHMDQNVEGNLVESKQITNLTAGVPGDVSISTLDGNNYTHWQPAVKSLPGKLLIDLGANNSQVINKGMILWGQRPAKNFTISILPHTDVIGQILSDLTTILENANVGDESVLEALEDIGGSSPLLSHTGDTDVKDLLSWKAEDVDDILLGISGESNVIRGKFVPILKDYKVEPSEPYFEEIYSKSIIEILPSNKTEFAIDYEKVQHNSTSCSHKDPSDNCTDWTKTRFIMVSIEGSYDDDDDERGGTIKEIVLMN

SEQ ID NO: 65 - protein, 1278 aa, Naumovozyma dairenensis
MSFLKRIFFKERPPIITATEVGYISSNCDVETYPLTSTETHIDNNINIDTNNTELYTNDSNNNNNYNNDNIPTIGEQRRQLNKTFNKATITKYLLAFIMIAGLIALAAVASTIDLSSAFSKGKSSQSMDEDINNIQPETPSAYKEGIISSTSDTNNPHVLGYDPETRKSSKKLYELMHDFDTAYYDDENMILGTNLFSENVYSRQPYVANGYIGSRIPNTGFGYALDTLNLFTDAEGSLNNGWPLRNRRYAGAFVSDFYSLQEKLNSTNFPELDNHGYSTVISSIPQWTNLQFSLDNGSIWFNPQEIDKTDVSNYQQNLSMKDGIVTTDMDWIDGMIHVKSEIWAHRKIYPLGMVSLEISLNVDSIPDGFESVDLDVWDVLDFNTSHRTVLNDIGYDDDGIYMVIEPDNVPYSNAALYSACTLQLENSTEEHPFQFDEDKDPLMNTNERISKVSHVTLSKANPKLTVHKYVGIMSTEYNNDEKNGGASNLDLATKVAMSSKGSYDLLLSTHKKAWYALYNDAFIEIPSDNLLEMTARSSLYQLLANTRTYNVSEERGLPLAVGGLSSDSYGGMVFWDSDIWVQPALLPFFPQIAKNINNYRNATHAQARLNAKQYGYPGAVYPWTSGRYANCTSAGPCVDYEYHINVDIAMATFSIYMNGGKDVDDNYLRYTTWPMVRDAAEFFTVYVKYNATLGKYETYNLTDPDEFADHINNGAFTNAGIKTLLKWATDIGNHLGEYVDPKWMEISHNIYIPRSKSNITLEYSGMNSSVEIKQADVTLMVYPLGYINDESILNNAIKDLYYYSERQSASGPAMTYPVFVAAASTLLNHGSSSQSYLYKSVLPYLRAPFAQFSEQSDDNFSTNGLTQPAFPFLTANGGFLQSILFGLTGIRYTYEVDEATKKINRVLRFNPVELPLLPGGIAIRNFKYMDQVLDIILNDHNGTIVHKSGGKPINIKVPNRKLIHDRDIDLFTRDEKRESLERRDQYEKEDPNDTSNDAKDSTKYGTSYVLHPGEELTIPLFKPELNIEGNIAESKQITNLTAGVPGDVGFSALDGNNYTHWQPADKKDNARLLIDLGEDNIKEIRKGMILWGQRPAKNISIAILPHTDTVENIFTNVSKILENSKNAEEYREGVIDLLNENNISVQSTSSTGEVEANTDLQSIISWKTDDFDEVLERFPRLGILGENFVTILQDYKIEPSEPYYEEVIKESLIEILPSNKTEFSIDYSRIHINSTRNNTEIGEWKKARYVLLTVHGTYDDDIDPKGATIKEIAFMEQ

SEQ ID NO: 66 - protein, 1152 aa, Lachancea thermotolerans
MSVRHKTRKHTATSLIARSLPGLRAIFVILATCVAAAGWRWLLTGELPRKPHLPCKVFRTHRHHDTRIEWRRRSSESLYELLTDSQDTYYDEDNWTVGTVFFSENTYSRQPYVANGFLGSRIPNVGFGYAPDTYNIWTPDPSIPGALNNGWPLRNQRFAGAFVSDFYSLQPHLNSTNFPELDADGYSTILSAIPQWTDMKISVKNDTVRFTAQDVLPQHVSNYHQNLSLLTGTVTTELDWMGLLHIKSTVLAHRILHPLGVLKLELSLIPDSGLKTLDLQVSDIFNHSTSRRTFLRDLGYDSRGIYMEVEPDNVPYSSAALYSSLRFDGPAEADGCIFQLSDMNTTVSRKNFLTLSCEKPSITIQKYVAVVSTEYDRYNKTASNMEAAKDIVHSQCGQYDLITQAHHNEWVSLYDNASIEIPSDSLLELSAKSSLFHLLANTRRFNISSSRGLPLPSSGLSSDSYGGMIFWDADIWILPALLPFFPDIARHMVDYRKNTHEQARLNAQQYGYPGALYPWTSGRYANCTSTGPCVNYEYHINIDIAMASFLVYLNGAPGVDDEYLRETTWPLVRDAAQFFTAYVKFNSSLDAYETHNMTDPDEYANFINNGAFTNAGIKTLLKWATDVGNHLQEEIDPRWVEVSDKMFIPIAESNITLEYSGMNASVEIKQADVMLMTYPLGYITDETILDNAIRNLYYYSERQSPSGPAMTYPVFVAAAAGLLNHGCSSQSYLYKSVLPYLRAPFAQFSEQSDDNFLTNGFTQPAFPFLTGNGGYLQSLLFGLTGLRYSYEVDKQTKKITRLLKFNPIKLPLLQGGIAINNFKYMGQVLDIIIGDEKATIVHKIGDEPINLKLIDRSFIHDRDVTGPHMTHVHEGEEVPVQWITLQPGQNLTVDLFRPLLNIDGNLIEGKQVSNFTAGVPGDVIYSVIDGNNFTHWQPLDKNVCAKILIDLGPGNEQNLTGGMILWGRRPARNISVAMVPYKGDIEQALQKASSVMESSGPDKRVEILGYTAPASELASRLSETEDRFFEEDYRLLLSSQRLDIEQLSKLSPESSLLKSKFVTILHNLQISPSEPYAEENQRGSKIVIPRSNSTHFTFDYSNYTSDKAFEHPVSKESGASWPPPRFVLVCIQGTYDDDDDPKGATIKEIALM

SEQ ID NO: 67 - protein, 1152 aa, Lachancea quebecensis
MSVRHKTRKHTATNLIVGSLPGLRAIFVILTACVAAVGWRWLLTGKLPKKPHLPCKVFRTHRHHDTRIEWRRRSSESLYELLTDSQDTYYDEDNWIVGTVFFSENTYSRQPYVANGFLGSRIPNIGFGYAPDAYNIWAADPSIPGALNNGWPLRNRRYAGAFVSDFYSLQPHLNSTNFPELDANGYSTVLSAIPQWTDMKLSIKNDTVRFTAQDVLPQHVTNYHQNLSLLTGTVTTELDWMGILHIKSTVLAHRTLHPLGVLNMELSLLSNSGLKTLDLQVSDIFNHSTSRRTFLRDLGYDSQGIYMEVEPDNVPYSSAAMYSSLRFIGSGESDGCIFQLSDMNTTVSRKNFLTLSNEKPSITIQKYVAVVSTEYDRYNKTASNMELAKDIVRSQCGHYDSITQMHHDEWVSLYGNASIEIPSDSLLELSARSSLFHLLANTRRFNISSSRGLPLPSSGLSSDSYGGMIFWDADLWILPALLPFFPDIARHMVDYRRNTHEQARLNAQQYGYPGALYPWTSGRYANCTSTGPCVDYEYHINIDIAMASFLVYLNGAPGVDDEYLRETTWPLVRDAALFFTAYVKYNSSLDAYETHNMTDPDEYANFINNGAFTNAGIKTLLKWATDVGNHLQEEVDPRWVEVSNKMFIPIAESNITLEYSGMNASVEIKQADVVLMTYPLGYITDETILDNAIRNLYYYSERQSASGPAMTYPVFVAAAAGLLNHGCSSQSYLYKSVLPYLRAPFAQFSEQSDDNFLTNGLTQPAFPFLTGNGGYLQSLLFGLTGLRYSYEVDQKTKKITRLLKFNPIKLPLLQGGIVINNFKYMGQVLDIIVGDENATIAHKVGDQPINLKLIDRNFIHDRDVAISDIKHVHESEKVPVQRVTLQPGQNLTVDLFHPLTNIDGNLVEGTQVSNFTAGVPGDVIYSVIDGNNYTHWQPLNKNACAKILIDLGPGNEQNLTGGMILWGRRPARNISIAMVPYKGDIEQALEKASKVIESNGPGKRVEILGYTAPASVLASRLSEAKDWHFEEDYRLLLSSQRLDIEQLSKLSPDSSLLDSKFVTILNNLQISPSEPYAEENQRGSKIVIPRSNSTHFTFDYSSYTNNTTFDHLTSNDSGASWPPPRFVLVCIQGTYDDDDDPRGATIKEIALM

SEQ ID NO: 68 - protein, 1202 aa, Tetrapisispora phaffii; identical to SEQ ID NO: 48

SEQ ID NO: 69 - protein, 1156 aa, Lachancea fermentati
MVGSINNRTCFSPYSRSVLYSENPSMKGRFQASRRFTYLGFLTTLAVLSWLTLADVHNDDEVTESALLSDRLKFRDLSSENIENSRKASQELEKQIVDSEDTYYDEQRRILGTTHFSENTYSRQPYVANGYIGSRIPNVGFGYALDTLNLWTPNSTVAGALDNGWPLRNQRFAGAFVADFYSLQAHLNSTNFPELDKKGYTTVITAIPQWTDLSFSLNDTFKFNPVDVHSDSITNYKQNLSMSEGIVTTEMDWHDLLHIETTIFAHRTIHPLGVVSMDITLNTSANLDGADYLDLQITDKLNYSTSRRAFLRNLGYETGSIYMTVEPDNVPYSSAVLYSSLEFPSQSLLNGTLYRINDNNSTVSQNQYVRITKDSPQINIKKYVGIVSSEFPRDDNSTNFELSKQIVEENIGHYDSLLASHIQGWSDLYNNTEVEIPSDSLLELAARSSIFHLLANTRSEDVSPERGLPLPVAGLSSDSYGGMVFWDADIWMMPSLLPFFPEIAKQIVNYRNVTHSQAVLNAQENDYLGAVYPWTSGRYANCTSTGPCIDYEYHINVDIAMSSFLLYLSGGAEADEDYLRYTTWPILRDAARFFTSYVKFNSTLGMYETKNMTDPDEFANFVDNGAFTNAGIKTLLKWATDVGTYLKYDVDSKWAEVSEHMFIPISQANITLEYTGMNASVEIKQADVVLMTYPLGFITDATILNNAIKDLYYYSERQSASGPAMTYPIFVAAASSLLNHGCSSQSYLYKSVLPYLRSPFAQFSEQSDDNFLTNGLTQPAFPFLTANGGFLQAIYFGLTGLRYSYKLDNSTGELVRFLKFDPVQMPLLPGGITLRGFRYMDQILDIVIDDAAATVYHKSGNSSVIIEISDRSIIYDQSNIFFENGSTLQFKKRDLPGTSYTLEPGSQLVFPLFKPNLNIDGNIAEGKQITNFTAGVSGDVVYSVIDGNNYTHWQPLDKYENAKLLIDLGPGNDEAVTHGMILWGQRPARNMSIYALLLSEQTELLLQNTSSTDQYEIQDIMSPSLNNEFKNDIDEDFEKFLTWKMLDINDFAQIASNLTILEGRFVPLLENLRITPSEPYYEQHEKNSEIDILPSNRTKFTINYQNVSAYGGANSSNDNSSSAFIPRYYLISVEGTYDDDDDDNGATINEIAFIAN

SEQ ID NO: 70 - protein, 1134 aa, Lachancea nothofagi
MEKHKIKQSRKGCMMGIFLTLAVLCSWVLVRELPKVARSPCKVFRSKKLFHDARIERRRRTSETLYELLSDSRDTYYDEEAWVVGTSFFSENTYSRQPYVANGYLGSRIPNVGFGYALDTYNIWTPDASIPGSLDNGWPLRNRRFAGAFVSDFYGLEPKFNSTNFPELDEKGYNSVLCAIPQWTDIKFSIKNDTFQFNAQSVNPSQISNYQQNLSLLTGTVTTEMDWLDVLHIKSSVFAHRIRHPLGTVQLEISLIPNNPEQLEVIDLQLSDVLNHSTSRRTFLRDIGYDSGGIYMEVEPNNVPYSSAALYSSLKISSAETNIDGVVFQLNDGGTSVTCKHLLQLTSDNSTVTINKFVGIVSSEYDRYNKAMSNLDAAKDVVRYTQTESYESLAEGHQQEWIKLYDNASIEIPSDSLLELAARSSLFHLLANTRRFNVSQERGLPVPASGLSSDSYAGLVFWDADLWIMPSLLPFFPDISKHMVTYRQSTHNQAKINAQENGYPGALYPWTSGRFANCTSTGPCVDYEYHINIDVAMASFLVYLNGADGIDDNYLRGTTWPLVRDAALFFSSYVDYNPALDAYETHNMTDPDEYANFISNGAFTNAGIRTLLKWATDIGHHLNESVDPKWADVSKKIVIPISDTNITLEYSGMNASVEIKQADVMLMTYPLGYITDETILDNAIRNLYYYSERQSASGPAMTYPVFVAAAAGLLNHGCSSQSYLYKSVLPYLRAPFVQFSEQSDDNFLTNGLTQPAFPFLTGNGGYLQSLLFGLTGLRYSYESNKTTGQITRLLKFNPIKLPLLAGGITIRNFKYMGQVLDVEIGDENATLVHKAGDQPIRLKLLNRNVIHDRELGRFDSSHVHELKQLPVRHAILEPGRNLTVKLFRPLLNIDNNLAEGKQVTNFTTGVPGDVIYSVTDGNNYTHWQPLHKCDCAKILIDLGADNEQTLTGGMIMWGKRPAQNISVSMFPFHGSIEEALFNASAIIEMSGPETETEIMGFKGAASDVKLKLKETKENCFEEDYQYLMQSQRLDIGQLSKISPESSLLKSKFVTILRDQKVSPSVPYIENDENKDRIMIPQSNTTQFTFDYSYYSNHSCAADWPPPRFVLVHVQGTYDNDDDPRGATIKEIALM

SEQ ID NO: 71 - protein, 1066 aa, Tetrapisispora blattae
MIFNILFSIFFNIFIILQYLQVVSGLKSQNKTNNLYQILIDNNDNSYYDSTNQILGTKQFTKQHAYSRQPYVANGYIGSRIPNVGFGYALDTINLWAANSSVEGALNNGWPLRNHRYAGSFVSDFFSQQEKLTSTNFPELDEVGYSTVIASIPEWTNIKIILSVNGTDHLISPEALIDENNMSNYFQNMSMSNGVVTTSFNYLNDLVNIKTEVFAHREISYLGILSLNVTLLNPNEYMMDQIDIQVVDILDFNSSHRTVLNEYGYDLKNGAIFMSVSPENTDDSVASLYSTLQIENDIEYNTAYSKINEKIEHSLSCKIDLNNPTIIFNKFVGIISTEYGNDADFNSTFKMAKSSILDLSLNYTQLYDSNYVAWKKLLENTDLSIPGDSLLDMTAKSSIFHLLSNTRSKNVADNRGLPVSVSGLSSDSYGGMVFWDSDLWIQPSLLPFFPKISNKMINYRNATHEQAKINANSYGYDGALYPWTSGKFANCTSTGPCFDYEYHINIDIALAAISLYMSGGGDEDYLRYTAWPIVNDAAKFFSEYVQYNETSGMYVTQNMTDPDEFADFIDNGAFTNAGIRSLLKWATDIGHHLNETIDENWMEISKNLYIPKADTNITLEYTGMNSTTKVKQADVALMVYPLGFITDESNLNDAVKDLFYYSEHQSAAGPAMTFPVFVAAASSLLNHGTSSESYLYKSVIPFLRGPFAQFSEQADDDFMKNGETQPAFPFLTAHGGFLQSILFGLTGIRYSYEMNTQTNKIERFLRFDPIKLELLNGGLHIQGFHFLGQTLDISTDDDFGYIKHKNGTQNIRIKVPTRNYFSDEVDIFTRNNKTSNFEKRTIGNEFFGREEEKSKSYSNGTFITLEPGEEVKIPLFKPLKNIPSNLAEGKQVANLTEGVPGDVPFSLVDGNNYTHWQPANKSSISRVIIDLGAYNSSNISGGQILWGSRPAKYFSISVIPSVFNFTTKVQMNKIIEEESISVIDNQVVLPSKPFYAEIVEDSIIDLLPSNVTNFEFNFKNINEKYPNHSNISNLIRYVLFSFEGTYDNDTEVTGATVKEISIISSD

SEQ ID NO: 72 - protein, 697 aa, Gaeumannomyces tritici
MPAMAPLWKLATAAAASSLAVNALYINGSEVTPCDSPIYCHGELLKQVELAHPFADSKTFVDMPTIKPVNEVLAAFDKLQKPLSNNTELQNFLRENFAKAGGELEEVPNSELATDPVFLNKLNDTVIREFVEKVIGIWPELTRRYKGPGQCSECANSFIPINRTFVVAGGRFREPYYWDSYWIVEGLLRTGGAFTQISKNTIENFLDLVETIGFVPNGARIYYRNRSQLPVLSQMVRVYVEHTNDTSILERAVPLLIKEHQFFVNNRSVEVTSRSGQTYTLNRYAVVNTQPRPESFREDYITANNRSYYAASGIIYPEARQLNESEKAELYSHLASGAESGWDYSTRWLAKPNDAAKDVYFPLRSLNTNNMVPVDLNSILYANELAISEFLNQTGNATGAAEWKRTAERRSEAMFALMWNETLWSYFDYNMTSKEQNIYIPLDDDATAFEQTTAPAGKQVLFHVAQFYPFWTGAAPAQLRDNPLAVQRAYSRVDAYLGLKGGAIPATNLRTGQQWDEPNVWPPLMHILMEGLTRVPATFGESDPAWLGVQDLALRLGQRYLDSTFCTWYATGGSTSQTPQLQGLTPEDTGIMFEKYGDNSTNVAGAGGEYEVVEGFGWTNGVLIWVADQFSTRLKRPNCGNITAANVHPSGGRRKRSLEQRSALEMHSSDAAWIKRFGRKAAKRSLGRTAGLGGGAV

SEQ ID NO: 73 - protein, 646 aa, Magnaporthiopsis poae
MAPSWKLAAAVTAWSLAVNALYINGTEITPCDSPIYCRGELLKQVELARPFADSKTFVDMPTIKPVDEVIAAFNKLQKPLSNNTELQNFLRENFAQAGGELEEVPNSELTTNPVFLKKLNDTVIREFVEKVIDIWPELTRRYKGPGQCSDCANSFIPVNRTFVVAGGRFREPYYWDSYWIVEGLLRTGGAFTQISKNTIENFLDLVETIGFVPNGARIYYRNRSQPPLLSQMVRIYIEHTNDTSILERAVPLLIKEHEFFVKNRSIEVTSRSGQKYTLNRYSVVNTQPRPESFREDYITANNRSYYAASGIIYPEGRQLNESEKAELYSYLASGAESGWDYCARWLRKPDDAAKDVYFPLRSLNTNNMVPVDLNSILYANELTISQFLNRTGNATGAAEWKGLAERRSEAMFALMWNETLWSYFDYNTTSGEQNIYVPLDDDATALEQITAPAGKQVLFHVAQFYPFWTGAAPKQLRDNPLAVLQAYSRVDAYLKLKGGAIPATNLRTGQQWDEPNVWPPLMHVLMEGLTRVPATFGESDPAWLGYGDNSTNVAGAGGEYEVVEGFGWTNGVLIWVADQFSTRLKRPNCGDITAAKVHASGGRKQSLAQRSALEMHPADAGWTKMFGRKAAKRSLARTVELGNGMV

SEQ ID NO: 74 - protein, 694 aa, Thermothelomyces thermophila
MALRHAATAALAGLSSSAAALYINGSVTAPCDSPIYCHGELLKGVELAHPFVDSKTFVDMPTLKPVDEVLAAFSKLRQPLSNNSELNNFLAEYFAPAGHELEEVPKGELQIDPKFLNKLEDRTIKEFVSKVIDIWPDLTRRYAGPGDCSGCANSFIPVNRTFVVAGGRFREPYYWDSYWILEGLLRTGGAFTQISKNIIENFLDFIDTIGFIPNGARIYYLNRSQPPLLTRMVKSYVDYTNDTSILERALPLLIKEHDFFTNNRSVSVTASNGKTYTLHRYHVENNQPRPESYREDYITANNGSYYAASGIIYPVKTPLNETEKAVLYSNLASGAESGWDYTARWLRVPDDAARDVYFPLRSLNVREMVPVDLNSILYENEVIIAEYLEKAGNSSEAKRFASAAKQRSEAMYNLMWNATHWSYFDYNLTSNAQNIFVPADEDTASFDRYAAPPGQQVLFHVAQLYPFWTGAAPAHLKSNPLAVQKAYARVSRRLDTKKGAIAATNYRTGQQWDQPNVWPPLQHVLMQGLLNTPATFGESDPAYQGVQKLALRLAQRYLDSTFCTWYATGGSTSDFPQLQGVSPDATGIMFEKYADSATNVAGGGGEYEVVEGFGWTNGVLIWAADVFGNKLKRPDCGNITAAHTHSEAKRSLGDGGLARRAVELDPWDAAWTKMFGRSKLRRREAEDVRKRWSS

SEQ ID NO: 75 - protein, 680 aa, Colletotrichum nymphaeae
MVNFALALAAVAVLPRTAQALYENGSVVAPCDSPIYCHGDILKEVELARPFSDSKTFVDMPAIKSLEEIQAAFNNLSKPLSNNTALNDFLRANFAAAGGELKEVPKDQLKTDPKFLDKINDTVIKEFSQKVIAIWPDLTRTYAGSTSNCTTCPNSFIPVNHTFVVAGGRFREPYYWDSFWILEGLLRTGGAFTEISKNVIENFLDLVEKLGFVPNGARIYYLNRSQPPLLAQMVRLYVEYTSDRSILERAIPLLIKEHEFWTTNRTVEVNKNGTTYTLNQYNVTNTQPRPESYREDYVTASNASYYSTNGIIYPEVEKLNDTEKARVYANLASGAESGWDYSSRWLSRPADAARDVYFPLRSLNVLETVPVELNSILYWNEMTIAALLNSTNNGTGAVAWTELATKRSQAMYDLMWNSTLSSYFDYNVTSGGQNIYIPKDDDASTLETNTAEAEQQVLFSVSQFYPFWTGAAPSHLKNNPYAVKQAYQRVEKYLDIKKGGIPATNLKTGQQWDQPNVWPPLMHVLMEGLRRTPATFGESDPAWRDVQSLALRLGQRYLDSTFCTWYATGGSTSETPQLQGLTAQSVGTMFEKYGDNSTNVAGGGGEYEVVEGFGWTNGVLLWAVDVFGNDLKRPDCGNITAANVHPAKRSLPQRAVELDSYDASWTKKFGRRAEEAAKRV

SEQ ID NO: 76 - protein, 680 aa, Colletotrichum orchidophilum
MVNFALALAAIAVLPQTAQALYENGSIVAPCDSPIYCHGDILREVELARPFSDSKTFVDMPAIKSLEEIQAAFNNLSKPLSNNTALNDFLRANFAAAGGELTEVPKDQLKTDPKFLDNINDTVIKEFSQKVIAIWPDLTRTYTGSASNCTTCPNSFIPVNHTFVVAGGRFREPYYWDSFWILEGLLRTGGAFTEISKNVIENFLDLVDKLGFVPNGARIYYLNRSQPPLLAQMVRLYVEYTNDRSILGRAIPLLIKEHEFWMTNRTVEVNRNGTTYSLNQYNVTNTQPRPESYREDYVTASNASYYSTSGIIYPEVEKLNDTEKARLYANLASGAESGWDYTSRWLSRPGDAARDVYFPLRSLNVLETVPVELNSILYWNEMTIAALLNSTQNGTGALTWTELAVKRSQAMYDLMWNSTLSSYFDYNVSSGAQNIYIPRDDDATEVETNTAGSQQQVLFSVSQFYPFWTGAAPSHLKNNPYAVKQAYQRVEKYLDNKKGGIPATNLKTGQQWDQPNVWPPLMHVLMEGLRKTPATFGESDPAWRDVQNLALRLGQRYLDSTFCTWYATGGSTSETPQLQGLTAQSVGTMFEKYGDNSTNVAGGGGEYEVVEGFGWTNGVLLWAVDVFGNGLKRPDCGNITAANVHPAKRSLSQRAVELDGYDAAWIKKFGRRAEEAARRL

SEQ ID NO: 77 - protein, 685 aa, Coniochaeta ligniaria
MALSRLMAALAASISVVNALYVNGSVTAPCDSPLYCQGDILKAIELAQPFSDSKTFVDMPTIKPLDEVIAAFNKLTLPITNNTELNDFLAANFAPAGGELETVPTNQLQTDPKFLDKLNDTVIREFSQAVIKIWPDLTRQYAGPSNCTGCVDSFIPVNRTFVVAGGRFREPYYWDSYWIVEGLLRTGGNFTAIARNTIENFLDLVETIGFVPNGARLYYLNRSQPPLLSKMVRSYVDYTNDTSILERAVPLLIKEHQFWQTNRTVVVTAADGKNYTLNRYHVNNNQPRPESFREDYITANNHSYYAASGIIYPEGKALNDSEKQQLYANLATGAESGWDYGTRWLARPNDAAKDVYFPLRSLNVVNIVPVDLNSILYGAESNIAHFLNQTGKSTEAYKWANLAAQRSEAMFALMWNSTLWSYFDYNLTSNAQNIYIPADDDAITAETSGAPAGYQILFDVAQLYPFWTGAAPDQLKDNPLAVKLAFSRVSSMLDRKAGGIPATNFQTGQQWDQPNVWPPLMHVLMAGLLNTPATFGEDDPSYQDVQALALRLGQRYLDSTFCTWYATGGSTSATPKLQGAGADAVGTMFEKYADNATNVAGGGGEYTVVEGFGWSNGVLLWAADTFADKLKRPDCGNITAANVNPGKRSVRSAVELDARDAKWTKMFGSVARRQAEKRDAEKRTY

SEQ ID NO: 78 - protein, 695 aa, Thielavia terrestris
MAPRSFVAAAALAGLISSASALYINGSVTAPCDSPLYCHGEILKAIELAHPFTDSKTFVDMPTIRPLDEVIAAFNRLSQPLSNNSELNAFLAANFAPAGGELEAVPRDQLHTEPSFLNKLDDTVIKEFVAKVIDIWPDLTRRYGGPGNCTACANSFIPVNRTFVVAGGRFREPYYWDSYWILEGLLRTGGAFTEISKNIIENFLDFVETIGFIPNGARIYYLDRSQPPLLARMVRSYVDYTNDTSILDRALPLLIKEHEFWSTNRSVSIKAPNGKTYTLNRYYVNNNQPRPESFREDYITANNGSYYAASGIIYPVNTPLNDTEKAELYANLASGAETGWDYSTRWLKNPNDAAKDIYFPLRSLNVRGTVPVDLNSILYENEVIISQYLKRAGNNSEAERWAYAASQRSEAMFELMWNATHWSYFDYNLTSNSQRIFVPVDDDATAAERAGAPRGQQVLFNIGQFYPFWTGAAPAQLKNNPLAVQQAYARVARMLDENAGGIPATNFVTGQQWDQPNVWPPLQHVLMEGLLNTPPTFGDADPAYQSVRALALRLAQRYLDSTFCTWYATGGSTSQTPQLQGVAPGAEGIMFEKYADNSTNVAGSGGEYEVVEGFGWSNGVLIWAADVFGAQLKRPDCGNITAAHTSGSGAQKRSGGSLARRAVELDPWDAAWTKMFGRSALKKREDVRKRWLLAA

SEQ ID NO: 79 - protein, 682 aa, Madurella mycetomatis
MVPRLSVTAALAAFASSAAALYINGSVIAPCDSPLYCQGEILHAIELARPFSDSKTFVDMPTIRPLEEVIAAFSRLTQPLSNNSELNDFLAANFAPAGGELEEVPEDELHTDPVFLDNLDDAVIREFVGQVIDIWPDLTRRYAGPGNCSECANSFIPVNRTFVVAGGRFREPYYWDSYWILEGLLRTGGAFTEISRNIIENFLDFVETIGHVPNGARVYYLNRSQPPLLTLMVKTYVDYTNDTSILERALPLLIREHEFWTNNRTVDVTASDGTTYRLNRYDVSNTQPRPESYREDWVTANNASYYAASGIIYPVRTPLNESEIAELYSNLASGAESGWDYTSRWLMRPNDAARDVYFPLRHLNVRNMVPVDLNSILYQNEVIISGYLEQAGNSTEAERFASAARERSEAMYALMWNETHWSYFDYNLTSNEQRIFVPTDANATTAELAGAPEGYQVLFDIAQLYPFWTGAAPDQLKNNPLAVQQAYSRVARMLDEKPGAIAATNFVTGQQWDQPNVWPPLQHILMQGLINTPATFGEDDPAYQAVQDLSLRLAQRYLDSTFCTWYATGGSTSETPQLQGVSPDATGTMFEKYSDAAINVAGGGGEYEVVEGFGWTNGVLIWAADTFAGRLTRPDCGDIEAAQTHSGERRAVELDPRDAAWTKKFGKRALKKRAESERKKRV

SEQ ID NO: 80 - protein, 692 aa, Neurospora crassa
MVSRFLGATVPLAAAILPGARALYVNGSVTAPCDSPIYCYGELLHQVELARPFSDSKTFVDMPTIKPVDEVLEAFSKLTLPLSNNSELHEFLSTYFGPAGGELEAVPTDQLHVSPTFLDNVSDDVIKQFVDSVINIWPDLTRKYVGAGELCTGCADSFIPVNRTFVVAGGRFREPYYWDSFWILEGLLRTGGAFTEISKNIIENFLDLVEQIGFVPNGARLYYLDRSQPPLLTQMVRIYVEHTNDTSILERAVPVLKKEWEWWTTNRTVEVTADGKTYSLQRYHVDNNQPRPESYREDYITANNNSYYATSGIIYPETTPLNDTQKALLYANLASGAESGWDYSSRWLKNPGDAARDVYFPLRSLNVLEIVPVDLNSILYQNEVTIGKFLAQQGSKDEAEEWAKKAEERSEAMYKLMWNSTLWSYFDYNLTSSSQNIYVPADPQVFPFEQPSGTPEGYQVLFSVNQMFPFWTGAAPDQLKGNPLAVKLAFERIKNLLDNKAGGIPATNFVTGQQWDEPNVWPPLMHVLMDGLLNTPATFGEDDPAYQETQTLALRLAQRYVDSTFCTWYATGGSTSETPKLQGLGSDLKGIMFEKYSDNSTNVAGSGGEYEVVEGFGWTNGVLIWAADKFGDKLKRPDCGDITPAQVGKRADITMEKRAVELDVFDAKFTKKFARKGKLEKLKAKFKRRAAI

SEQ ID NO: 81 - protein, 682 aa, Verticillium dahliae
MTLLSKSVVALAAAAPLARAQLFRNGSVIAPCDSAIYCHGEILSQIQLARPFEDSKTFVDMPAKRSLEQIQEAFDELEKPLTNNTALNDFLAANFALAGGELSEVDDLETDAQFLDNINDTVIREFTEKVIEIWPDLTRSYTGAGSNCTDCPNSFIPINRTFVVAGGRFREPYYWDSFWILEGLLRTGGSFIEVSRNHIENFLDLVDQYGFVMNGARRYYLNRSQPPLLSQMVRLYVDHTNDTDILDRALPLLIKEHEWWTVNRTVEVSKDGRTYQLNLYNVSNTQPRPESYYEDYTTASNSSYYAESGIIYPETRELNDTEKAFLYANLASGAESGWDYTSRWLSKPNDAVRHVYFPLRSLNIVNIVPVELNSILYWNEVTIAGYLNQTSNETQAAEWTELAANRSEAMYNLMWNDTLSGYFDYNLTSGAQDTFVPADDDTTDLEATGAPEGQQVYFSVAQFYPFWTGAAPAHIKNNPLAVKTAFERVATYLDTKDGGIPATNLRTGEQWDQPSVWPPLMHILMEALRNTPATFGESDPHYMEVQDLALRLGQRYLDSTFCTWYATGGSTSDTPQLEGFDEREVGIMFEKYSDNSTNQAGGGGEYEVVEGFGWTNGVLLWVVDTFGNNLTRPDCGDIEAANVQPSKRSAVELHRRDAAWTKKFGSRSAKGEAKRFAKLRGY

SEQ ID NO: 82 - protein, 688 aa, Gibberella zeae
MPSPRHIAAALVATATTASALYVNGTVVAPCDSPIYCHGDILEQVELARPFSDSKTFVDMPAIRPLSDIQEAFDKLEKPLRNNSALADFLDENFDDAGNELEEVSRDDLDTDPKFLDNINDTVIREFTEKVIDIWPDLTRRYDQDAKNCSDCPNSFIPVNRSFVVAGGRFREPYYWDSYWIILGLLRTGGSFIEIAKNTIENFLDFIEEYGFVPNGARIYYLNRSQPPLLSQMIKAYVEYTNDTDILERALPLLVQEHEFFMNNRSVPVYINNETYYLNTYNVSNTRPRPESYREDYITAENTSYYSPESGKVYKGGEELSFKQKEALYGNLASGAESGLDYTVKWIARPEDAIRDNYFPLRYLNTRNIIPVDLNSILYGNEIAIADFYEQTGNNSASEQWREVAANRSYAMHGFLWNETLWSYFDYNLTSKAQQIYFPVDENTTVVDTEDAPKGQQVFFSPTQFYPFWLGAAPDYLKNNPFAVYTAYKRVEYYLDNRDGGIPASNVETGQQWDQPNVWPPLMHILMAGLERVPPTFGIRDPSFVEVRRLALRLGQRYLDSTFCTWYATGGSTSETPKLQSTSDEEEGIMFEKYADNATNVAGGGGEYEVVEGFGWTNGVLIWAVDEFKNRLTRPKCDNLESAHSNDKRDPSAVMLNARDAKRVKKFGRRKRAAEKAAKKRSSRVFYF

SEQ ID NO: 83 - protein, 15 aa, Kluyveromyces lactis
QPYVANGYIGSRIPN

SEQ ID NO: 84 - protein, 17 aa, Kluyveromyces lactis
GVAGLSSDSYGGMVFWD

SEQ ID NO: 85 - protein, 20 aa, Kluyveromyces lactis
NITLEYSGMNSSVEIKQADV

SEQ ID NO: 86 - protein, 13 aa, Kluyveromyces lactis
NITLEYSGMNSSV

SEQ ID NO: 87 - protein, 698 aa, Magnaporthe grisea
MSPLWKTAAAIAVAASGSLVNAVYINGSIITPCDSLIYCRGELLKEVELAHPFADSKTFVDMPTIKPVDEVIEAFNKLQKPLSNNTELQDFLRENFAQAGGELEEVPNSELETDPVFLDKLDDTVIREFVEKVIDIWPSLTRRYKGPSNCEACADSFIPVNRTFVVAGGRFREPYYWDSYWILEGLLRTGGAFTNISKNTVENFLDLVETIGFVPNGARIYYKNRSQPPLLSQMVRIYVEHTNDTSILGRAVPLLIKEHEFFINNRSIDVEASNGKTYRLQRYAVTNTQPRPESYREDYITASNRSYYSPSGIIYPESHQLNESEKAVLYSHLASGAESGWDYTSRWLSTPSDAVRDNYFPLRSLNTNNIVPVDLNSILYANEVAIAEFLNRTGNSTGASDWMDLAKQRSEAMYALMWNETLWSYFDYNMTSKTQNRFIPVDEDAVSIETNNAPAGQQVFFHVAQYYPFWTGAAPRSLKNNPLAVLRAYERIDAYLDIKRGAIPATNLKTGQQWDEPNVWPPLMHILMEGLTRVPATFGEDDVAWTEIQDLALRLGQRYLDSTFCTWYATGGSTSETPQLQGLNAEDKGIMFEKYGDNSTNVAGSGGEYEVVEGFGWTNGVLMWVADTFNNKLTRPDCGNITAANVHSDGSQARKRGEMWSALEMHPYDAAWTKEFGARKVRRDKAEARALGNVMGGV

SEQ ID NO: 88 - protein, 676 aa, Magnaporthe grisea
VYINGSIITPCDSLIYCRGELLKEVELAHPFADSKTFVDMPTIKPVDEVIEAFNKLQKPLSNNTELQDFLRENFAQAGGELEEVPNSELETDPVFLDKLDDTVIREFVEKVIDIWPSLTRRYKGPSNCEACADSFIPVNRTFVVAGGRFREPYYWDSYWILEGLLRTGGAFTNISKNTVENFLDLVETIGFVPNGARIYYKNRSQPPLLSQMVRIYVEHTNDTSILGRAVPLLIKEHEFFINNRSIDVEASNGKTYRLQRYAVTNTQPRPESYREDYITASNRSYYSPSGIIYPESHQLNESEKAVLYSHLASGAESGWDYTSRWLSTPSDAVRDNYFPLRSLNTNNIVPVDLNSILYANEVAIAEFLNRTGNSTGASDWMDLAKQRSEAMYALMWNETLWSYFDYNMTSKTQNRFIPVDEDAVSIETNNAPAGQQVFFHVAQYYPFWTGAAPRSLKNNPLAVLRAYERIDAYLDIKRGAIPATNLKTGQQWDEPNVWPPLMHILMEGLTRVPATFGEDDVAWTEIQDLALRLGQRYLDSTFCTWYATGGSTSETPQLQGLNAEDKGIMFEKYGDNSTNVAGSGGEYEVVEGFGWTNGVLMWVADTFNNKLTRPDCGNITAANVHSDGSQARKRGEMWSALEMHPYDAAWTKEFGARKVRRDKAEARALGNVMGGV

SEQ ID NO: 89 - protein, 1109 aa, Candida glabrata
STNSYFSSSLASASPLFNKEGRVVRPMRESNLGLHADPQTRKSSKTLYDLLSDFDNAFYDDENMILGSLAFGENTYSRQPYVANGYIGSRIPNIGFGYALDTLNLYADAPGALNNGWPLRNRRFAGSFVSDFYSLQAKLNSTNFPELDEKGYTTVISSIPEWTDLQFTVDLNGTNWFNPQSVLIDDVINYNQNLSMKDGIVSTNMDWLNGMINIKSEVWAHRKIHSLGITRLEISLNLDALPDEFTELPVTIYDIIDFNTSHRTTLYEKGQDEDNKAIYMIVNPENVPYSNAVVYSTCTIKGTENNFSPYNFTSDDRIARNYMTNLTEENPKVVIYKYTSVVSSEYNNDEPNPNVNLKFASNIANTAKGNYKSLLSNHKRAWYDLYNDAFIEIPSDSLLEMTARSSLFHLLANTRQYNVSTTRGLPVGVGGLSSDSYGGMVFWDADVWMAPALLPFFPNIAMNMNNYRNATHQQAIENAKQYNYPGAVYPWTSGRYANCTSTGPCIDYEYHINVDIALASFSIYMNGAEGADEDYLRFTTWPMVKDAAVFFKAYVKYNETLGEYETYNLTDPDEFANHVNNGAFTNAGIKTLLKWATDIGTHLGEEVDPKWMEIADNIHIPRSDSNITLEYSGMNSSVEIKQADVTLMVYPLGYINDESILNNAIKDLYYYSERQSASGPAMTYPVFVAAAASLLNHGSSSQSYLYKSVLPYLRSPFAQFSEQSDDNFLTNGLTQPAFPFLTANGGFLQSILFGLTGLRYSYEVTPRTKKISRLLKFDPVKLPLLPGGIAIRNFKYMGQVLDIIIDDNNGTIAHKGGDKPIRIKVPNRDILHDRNITSALYSKRDDDLSATDDYYGTYFTLYPNEELVIPLYDTKLNIDGNIAESKQITNLTAGVPGDVGFSALDGNNYTHWQPFDKSDNAKLLIDLGFNSTHVIKKGIILWGQRPAKNISLSVLPHSERIEQLFANITDLLETSSITKGGSLLNQMLGQTQSNVTAEIDDDILALLNWKGDDLDQLIPYLPDMHLLQEKFIPILKDYPIKPNQRYYKEIIDDDIIKLLPSNTTEFTIDYNSIPGGEKRARYVVLTVHGTYDDDDDLKGATIKEIVLQE

SEQ ID NO: 90 - protein, 1020 aa, Candida parapsilosis
RFSEAFPFVLPRAEKYTLEQTSDSNLGDFVNSFENKEIFSQVQFSEHAFYDRKMNVVGTIEYSKYNQFQKQPYVANGYIGSRIPNLGHGFTYDQLTESPDSKKDDLYNGWPLFDKRFSGAFIAGFYDLQENTTGNNFPELLKNGYESVISAIPQWTTLKLAIQHGDKRYTLDPASPDGVGQITNYVQNMSLSTGIVTTQFTWLESLDVRYTVLAHRSEINLGLVKVDIKNKGNDTVEIDVIDELNFDTAQRCSLNLIGHDNSGIYVSFSPDNLDYISGAIYSTLHLDSVKRHSKNKKTNQTSSIRLHAQDSTQFGKTVGIVSTDLDPSKFKNSRDTLEFAKKVSQKFEYLDLVIKSHVRAWKELMGKQSTITFPNDPLLDLGSKASVYHLLANTRPDAQGLTGALGVAGLSSDSYGGMVFWDTDFWMFRAILALDPTHAKSIVNYRMHTHQQALKNTPQGYEGAAYPWTSGRFGNCTATGPCLNYEYHINSAIAMAAWELYISGAVDDQYLESTVYPLISDAAKFYADYVTSYNETIDKFITSNLTDPDEYANHVDNGAYTNAGIALLMNWINDIGDILGIKMPEIYTDISQKMYLPTADNSQNITLEYSGMNSSVGIKQADVVLMTYPLQNSLVDDEQAYINMEFYSGKQVSYGPAMTFSIFSIVAANLATSGCASQSYLHKAMQPYLRGPFAQFSEQNNDNFKTNGGTHPAYPFLTAHGGFIQAVVNGLTGLRHSYTIDNGKIRRSLFLDPIALPCLGDGVQYSGIHYDNHTISMNITGSTFVIRNEGKTNKRANDYISITIADRNPGRGTYKLKDNEEKSFKLYQPSKIFEDSVSECGLATFYNITESAPGDSSFSINDGDNTTRWQVKYNDTTGKVLIDLHSIKNITGVVFNWADKPPKKVKLSKYMGTKFKDVTDFLAKVDFGNYVYKNYRFANPGEKLLNQSEVFENVYSDDVTINAPFSSKELEEVIVPVRHNTTSWNINLQGRFLLLEVDGIHNTIPIEDDYGGAKLAEVNF

SEQ ID NO: 91 - protein, 1126 aa, Kluyveromyces lactis
TKPLPLQHTHFGSFVCAEDTLFCPESQRKASEKMYSLLKDHENTFYDEEQQILGNLLLSENTFSRQPYVANGYIGSRIPNLGFGYALDTINVWVNDSSIPGALDNGWPLRNQRFAGAFISDFYCLQEKLNSTNFPELDDDGYSTVISTIPQWTDLSILKHTTTGQIEYINPTDVKLDKITNYMQNLSLQDGIVTTTFVYDKQLLVTTKVVAHRKIYPLGVVTLELSLFDNNSDTSADNENEYVELEICDSLNFSTSHRTVLNDYGYDQNNEGIFMVVEPENVPYSNASLFSYFDIPSRDTLTLSKYSDSISQCTTQILKANSTFVAHKYIGIISSEYDNKQPDDNSNGTSNEALKMSNLERATSIVLDNKGNYDSLIQSHKNAWKRIYKDASIEIPSDGLLEMTAKSSIYHLLANTRSHNVSEDRGLPIGVSGLSSDSYGGMVFWDSDLWILPALLPFFPNAARQINNYRNASLHQAKLNAEKYGYDGALYPWTSGRYANCTSTGPCVDYEYHINVDIALSSFAIYMNGDEDDERSEEYLRYTTWPFVENAAKMFAQYVKWNDTMQQYTTHNLTDPDEYANFVDNAAFTNAGIQSVMVWAHDIARHLGIDPDPQWLEIADNIHIPISETNITLEYSGMNSSVEIKQADVVLMIYPLSYITDQSILNNAIKNLYYYSERQSASGPAMTYPVFVAGAASLLNYGSSSQSYLYKSVVPYLRSPFAQFSEQSDDNFLTNGLTQPAFPFLTANGGFLQSILFGLTGLRYSYEVDEDTGKIHRLLKFNPIQLPLLPGGIRINNFKYMGQVLDVLITDTEGIIIHKNGTKEIRIKVPDRTLIPDVDVKYSEETDPIKQILHGRRSVPTGKNYFTIQPGDVFKTPLYIPKKNLEGNLVEAKQITNLTAGVPGDVAVSVIDGNNFTHWQPAYKNLPARLLIDMGNNFTQEIKSGKIIWGSRPAKTFSLSILPQTEEVFKNLTHILSNVNQYCNKTGDECVRDLERTEKGFDAAIEDVFDWYGIDPDSIISTHPELKDMKTKFVKILDHYKVTPSEPYPWRVYNESQIVLLPGNETDFDIDYSKVAEMNPENVDIDFRGNQTDWRKGRFIVLTVHDTYDDDDDEKGATIKEFALFP

SEQ ID NO: 92 - protein, 695 aa, Artificial Sequence
  Sequence put together from multiple organisms, M. grisea and S. cerevisiae
MKFISTFLTFILAAVSVTAVYINGSIITPCDSLIYCRGELLKEVELAHPFADSKTFVDMPTIKPVDEVIEAFNKLQKPLSNNTELQDFLRENFAQAGGELEEVPNSELETDPVFLDKLDDTVIREFVEKVIDIWPSLTRRYKGPSNCEACADSFIPVNRTFVVAGGRFREPYYWDSYWILEGLLRTGGAFTNISKNTVENFLDLVETIGFVPNGARIYYKNRSQPPLLSQMVRIYVEHTNDTSILGRAVPLLIKEHEFFINNRSIDVEASNGKTYRLQRYAVTNTQPRPESYREDYITASNRSYYSPSGIIYPESHQLNESEKAVLYSHLASGAESGWDYTSRWLSTPSDAVRDNYFPLRSLNTNNIVPVDLNSILYANEVAIAEFLNRTGNSTGASDWMDLAKQRSEAMYALMWNETLWSYFDYNMTSKTQNRFIPVDEDAVSIETNNAPAGQQVFFHVAQYYPFWTGAAPRSLKNNPLAVLRAYERIDAYLDIKRGAIPATNLKTGQQWDEPNVWPPLMHILMEGLTRVPATFGEDDVAWTEIQDLALRLGQRYLDSTFCTWYATGGSTSETPQLQGLNAEDKGIMFEKYGDNSTNVAGSGGEYEVVEGFGWTNGVLMWVADTFNNKLTRPDCGNITAANVHSDGSQARKRGEMWSALEMHPYDAAWTKEFGARKVRRDKAEARALGNVMGGV

SEQ ID NO: 93 - DNA, 4884 bp, Artificial Sequence
  Sequence put together from multiple organisms: Saccharomyces cerevisiae and Rhizopus microsporus
ctaaattcggccttgctcagagactcctggattttggctaacaacgcagtcccttcgatgcatatagctaggccacaaattatgccaataacggtccatgggttgatgttttcttgaattctttcgtttttcatgctatttgcgtcttcccaagtcccagcgttccagtattcatactgcgcgttagagtggtagccataagagccggcatattggtaattttcagtattaacgttagaacgtggtgaatacgatgtggtccagccttgcctcgttgtgtcatatacgatctttttctttgggtcacaaagaatatcatatgcttgagagatgactttaaatctatgtagtttttcgcttgatgttagcagcagcggtgatttactatcactgttggtaaccttttctgagctaaatatttgaatgttatcggaatggtcagggtggtacaattttacataacgatgatattttttttttaacgacttcttgtccagtttaggatttccagatccggcctttggaatgccaaaaatatcatagggagttggatctgccaactcaggccattgttcatcccttatcgtaagttttctattgccatttttatcgttcgctgtagcatacttagctataaaagtgatttgtgggggacacttttctacacatgataagtgccacttgaataaaaatgggtatacgaacttatggtgtagcataacaaatatattgcaagtagtgacctatggtgtgtagatatacgtacagttagttacgagcctaaagacacaacgtgtttgttaattatactgtcgctgtaatatcttctcttccattatcaccggtcattccttgcaggggcggtagtacccggagaccctgaacttttctttttttttttgcgaaattaaaaagttcattttcaattcgacaatgagatctacaagccattgttttatgttgatgagagccagcttaaagagttctcgagatctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagtttaaaacaccaagaacttagtttcgaataaacacacataaacaaacaaatctagaatgaaacttatgaatccatctatgaaggcatacgttttctttatcttaagctacttctctttactcgttagctcagctgcggtgccaacctctgccgccgtacaagttgagtcatacaattatgacggtaccactttttcaggtagaatattcgtcaaaaacattgcctactcaaaggtcgtaacagttatctactccgatggatcagataactggaacaataacaacaacaaagtttctgcagcttactcagaagcaatttctgggtctaactacgaatactggacattctccgcaaagttatccggaattaaacagttttatgtcaaatacgaagtttctggttcaacatattacgacaacaacggtaccaaaaactaccaagtccaagcaacctcagcgacatctacaacagctactgcaaccacaactacagctactggcacaacaactacttctacaggtccaactagtactgcatccgtatcattccctaccggtaactcaacaatttcttcctggataaaaaatcaagaggaaatcagccgttttgctatgttgagaaatatcaatccacctgggtctgccacagggttcatagccgcatctctgtccacagccggcccagattactattactcttggactagagattcagcactaacagctaatgtgatcgcttacgaatacaacacaacattcactggaaacaccacccttcttaagtacttgaaagattacgttacattttctgtcaaaagccaatctgtatctaccgtttgtaactgtctgggagaaccaaagttcaacgctgatggtagttcttttacaggtccatggggcagaccacaaaacgacggaccagcagagagagctgttacttttatgttgattgctgacagctacttgactcaaactaaggacgcatcctacgttaccggtacattaaagccagcaatcttcaaagatcttgattacgtagtttctgtttggtctaacggttgctacgatttatgggaagaggttaatggtgttcatttctatactctcatggtcatgagaaagggtttgatcttaggtgccgacttcgctgctagaaatggtgactctagtagagcttcaacctacaagcaaactgcatcaacaatggaatcaaagatcagttctttttggtcagattctaacaactacgtccaagtttctcaatcagttaccgccggagtgtcaaaaaagggactagatgttagtacactattggcggccaacattggtagtctgcctgatggctttttcactccaggctccgaaaagatattggctacagcagtggcgttagaaaatgcattcgcatccttgtacccaattaactctaacctaccttcttacttgggtaactcaattggaagatatcctgaggatacatacaacggtaatggcaactctcaggggaatccatggttccttgccgtcaacgcatacgcagaactttactacagagctattaaggaatggattagtaatggcaaggtgacagtatccaatatctcactacctttcttcaaaaagtttgattcttccgccacttctggaaagacatacactgctggtacatcagatttcaataacttggctcagaacattgctttaggcgccgatagattcctgtctactgttaagttccacgcatacactaacgggagtctatcagaagagtacgatagatctaccggtatgagtactggggctcgtgatttaacatggtcccatgcttcattgatcacagtggcgtacgcaaaggccggtagtcctgcagcttagttaattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacggccggccataacttcgtataatgtatgctatacgaagttatggcaacggttcatcatctcatggatctgcacatgaacaaacaccagagtcaaacgacgttgaaattgaggctactgcgccaattgatgacaatacagacgatgataacaaaccgaagttatctgatgtagaaaaggattagagatgctaagagatagtgatgatatttcataaataatgtaattctatatatgttaattaccttttttgcgaggcatatttatggtgaaggataagttttgaccatcaaagaaggttaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacgc

SEQ ID NO: 94 - DNA, 1790 bp, Saccharomyces cerevisiae
ggaagagctcctactgcgccaattgatgacaatacagacgatgataacaaaccgaagttatctgatgtagaaaaggattagagatgctaagagatagtgatgatatttcataaataatgtaattctatatatgttaattaccttttttgcgaggcatatttatggtgaaggataagttttgaccatcaaagaaggttaatgtggctgtggtttcagggtccataaagcttttcaattcatctttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcgcacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagagccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaattggaaagaaaaagcttcatggcctttataaaaaggaaccatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttgataacttcgtataatgtatgctatacgaagttatgcggccgccagcacgcagcacgctgtatttacgtatttaattttatatatttgtgcatacactactagggaagacttgaaaaaaacctaggaaatgaaaaaacgacacaggaagtcccgtatttactattttttccttccttttgatggggcagggcggaaatagaggataggataagcctactgc

SEQ ID NO: 95 - protein, 605 aa, Rhizopus microsporus
MKLMNPSMKAYVFFILSYFSLLVSSAAVPTSAAVQVESYNYDGTTFSGRIFVKNIAYSKVVTVIYSDGSDNWNNNNNKVSAAYSEAISGSNYEYWTFSAKLSGIKQFYVKYEVSGSTYYDNNGTKNYQVQATSATSTTATATTTTATGTTTTSTGPTSTASVSFPTGNSTISSWIKNQEEISRFAMLRNINPPGSATGFIAASLSTAGPDYYYSWTRDSALTANVIAYEYNTTFTGNTTLLKYLKDYVTFSVKSQSVSTVCNCLGEPKFNADGSSFTGPWGRPQNDGPAERAVTFMLIADSYLTQTKDASYVTGTLKPAIFKDLDYVVSVWSNGCYDLWEEVNGVHFYTLMVMRKGLILGADFAARNGDSSRASTYKQTASTMESKISSFWSDSNNYVQVSQSVTAGVSKKGLDVSTLLAANIGSLPDGFFTPGSEKILATAVALENAFASLYPINSNLPSYLGNSIGRYPEDTYNGNGNSQGNPWFLAVNAYAELYYRAIKEWISNGKVTVSNISLPFFKKFDSSATSGKTYTAGTSDFNNLAQNIALGADRFLSTVKFHAYTNGSLSEEYDRSTGMSTGARDLTWSHASLITVAYAKAGSPAA

SEQ ID NO: 96 - DNA, 4474 bp, Artificial Sequence
  Sequence put together from multiple organisms: Saccharomyces cerevisiae, Rhizopus microsporus, and Aspergillus nidulans
gtgtttgttaattatactgtcgctgtaatatcttctcttccattatcaccggtcattccttgcaggggcggtagtacccggagaccctgaacttttctttttttttttgcgaaattaaaaagttcattttcaattcgacaatgagatctacaagccattgttttatgttgatgagagccagcttaaagagttctcgagatctcccgagtttatcattatcaatactgccatttcaaagaatacgtaaataattaatagtagtgattttcctaactttatttagtcaaaaaattggccttttaattctgctgtaacccgtacatgcccaaaatagggggcgggttacacagaatatataacatcataggtgtctgggtgaacagtttattcctggcatccactaaatataatggagcccgctttttttaagctggcatccagaaaaaaaaagaatcccagcaccaaaatattgttttcttcaccaaccatcagttcataggtccattctcttagcgcaactacacagaacaggggcacaaacaggcaaaaaacgggcacaacctcaatggagtgatgcaacctgcttggagtaaatgatgacacaaggcaattgacctacgcatgtatctatctcattttcttacaccttctattaccttctgctctctctgatttggaaaaagctgaaaaaaaaggttgaaaccagttccctgaaattattcccctatttgactaataagtatataaagacggtaggtattgattgtaattctgtaaatctatttcttaaacttcttaaattctacttttatagttagtcttttttttagtttaaaacaccaagaacttagtttcgaataaacacacataaacaaacaaatctagaatgaaacttatgaatccatctatgaaggcatacgttttctttatcttaagctacttctctttactcgttagctcagctgcggtgccaacctctgccgccgtacaagttgagtcatacaattatgacggtaccactttttcaggtagaatattcgtcaaaaacattgcctactcaaaggtcgtaacagttatctactccgatggatcagataactggaacaataacaacaacaaagtttctgcagcttactcagaagcaatttctgggtctaactacgaatactggacattctccgcaaagttatccggaattaaacagttttatgtcaaatacgaagtttctggttcaacatattacgacaacaacggtaccaaaaactaccaagtccaagcaacctcagcgacatctacaacagctactgcaaccacaactacagctactggcacaacaactacttctacaggtccaactagtactgcatccgtatcattccctaccggtaactcaacaatttcttcctggataaaaaatcaagaggaaatcagccgttttgctatgttgagaaatatcaatccacctgggtctgccacagggttcatagccgcatctctgtccacagccggcccagattactattactcttggactagagattcagcactaacagctaatgtgatcgcttacgaatacaacacaacattcactggaaacaccacccttcttaagtacttgaaagattacgttacattttctgtcaaaagccaatctgtatctaccgtttgtaactgtctgggagaaccaaagttcaacgctgatggtagttcttttacaggtccatggggcagaccacaaaacgacggaccagcagagagagctgttacttttatgttgattgctgacagctacttgactcaaactaaggacgcatcctacgttaccggtacattaaagccagcaatcttcaaagatcttgattacgtagtttctgtttggtctaacggttgctacgatttatgggaagaggttaatggtgttcatttctatactctcatggtcatgagaaagggtttgatcttaggtgccgacttcgctgctagaaatggtgactctagtagagcttcaacctacaagcaaactgcatcaacaatggaatcaaagatcagttctttttggtcagattctaacaactacgtccaagtttctcaatcagttaccgccggagtgtcaaaaaagggactagatgttagtacactattggcggccaacattggtagtctgcctgatggctttttcactccaggctccgaaaagatattggctacagcagtggcgttagaaaatgcattcgcatccttgtacccaattaactctaacctaccttcttacttgggtaactcaattggaagatatcctgaggatacatacaacggtaatggcaactctcaggggaatccatggttccttgccgtcaacgcatacgcagaactttactacagagctattaaggaatggattagtaatggcaaggtgacagtatccaatatctcactacctttcttcaaaaagtttgattcttccgccacttctggaaagacatacactgctggtacatcagatttcaataacttggctcagaacattgctttaggcgccgatagattcctgtctactgttaagttccacgcatacactaacgggagtctatcagaagagtacgatagatctaccggtatgagtactggggctcgtgatttaacatggtcccatgcttcattgatcacagtggcgtacgcaaaggccggtagtcctgcagcttagttaattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacggccggccataacttcgtataatgtatgctatacgaagttatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtggcgttaattacccgtactaaaggtttggaaaagaaaaaagagaccgcctcgtttctttttcttcgtcgaaaaaggcaataaaaatttttatcacgtttctttttcttgaaaaattttttttttgatttttttctctttcgatgacctcccattgatatttaagttaataaatggtcttcaatttctcaagtttcagtttcgtttttcttgttctattacaactttttttacttcttgctcattagaaagaaagcatagcaatctaatctaagttttaattacaaaatgccacaatcctgggaagaattggccgccgacaaacgtgcccgtttggctaaaaccattcctgacgaatggaaggttcaaactttgcctgccgaagattccgttattgatttcccaaagaagtccggtattttgtctgaggctgaattgaagattaccgaagcctctgctgctgatttggtctccaagttggccgctggtgagttgacttctgttgaagtcactttggctttttgtaagagagctgctattgctcaacaattaaccaactgtgctcacgaattcttcccagatgctgctttagctcaagctagagaattagatgaatactacgctaagcataagagaccagttggtccattacacggtttaccaatctctttaaaggaccaattgcgtgttaagggttacgaaacctccatgggttacatttcctggttaaacaaatacgatgaaggtgattccgtcttaaccaccatgttgagaaaagctggtgctgttttctacgttaagacctctgtcccacaaaccttgatggtctgtgaaaccgtcaacaacatcattggtagaactgtcaatccaagaaacaaaaattggtcctgtggtggttcttctggtggtgaaggtgctattgttggtattagaggtggtgttattggtgtcggtactgacattggtggttccattagagtcccagctgctttcaactttttatacggtttgagaccatctcacggtagattgccatatgctaaaatggctaactctatggaaggtcaagaaaccgttcactccgtcgttggtcctatcactcactccgtcgaagacttgagattgttcaccaaatctgtcttgggtcaagaaccttggaagtacgactctaaggtcatccccatgccatggagacaatctgaatctgacatcattgcctctaagattaagaatggtggtttgaacattggttattacaatttcgacggtaacgtcttgccacacccaccaattttacgtggtgtcgaaactaccgttgccgctttggc

SEQ ID NO: 97 - DNA, 1878 bp, Artificial Sequence
  Sequence put together from multiple organisms: Saccharomyces cerevisiae, and Aspergillus nidulans
gaagattaccgaagcctctgctgctgatttggtctccaagttggccgctggtgagttgacttctgttgaagtcactttggctttttgtaagagagctgctattgctcaacaattaaccaactgtgctcacgaattcttcccagatgctgctttagctcaagctagagaattagatgaatactacgctaagcataagagaccagttggtccattacacggtttaccaatctctttaaaggaccaattgcgtgttaagggttacgaaacctccatgggttacatttcctggttaaacaaatacgatgaaggtgattccgtcttaaccaccatgttgagaaaagctggtgctgttttctacgttaagacctctgtcccacaaaccttgatggtctgtgaaaccgtcaacaacatcattggtagaactgtcaatccaagaaacaaaaattggtcctgtggtggttcttctggtggtgaaggtgctattgttggtattagaggtggtgttattggtgtcggtactgacattggtggttccattagagtcccagctgctttcaactttttatacggtttgagaccatctcacggtagattgccatatgctaaaatggctaactctatggaaggtcaagaaaccgttcactccgtcgttggtcctatcactcactccgtcgaagacttgagattgttcaccaaatctgtcttgggtcaagaaccttggaagtacgactctaaggtcatcccaatgccatggagacaatctgaatctgacatcattgcctctaagattaagaatggtggtttgaacattggttattacaatttcgacggtaacgtcttgccacacccaccaattttacgtggtgtcgaaactaccgttgccgctttggccaaggctggtcacaccgttactccatggactccatacaagcatgatttcggtcatgacttgatttcccacatctatgctgctgatggttctgccgacgtcatgagagacatttctgcctctggtgagccagccatccctaacattaaggacttgttgaacccaaatattaaggctgttaacatgaacgaattgtgggacactcatttacaaaagtggaactatcaaatggaatacttggaaaagtggcgtgaagctgaagaaaaagctggtaaggaattggacgctattatcgctccaattactcctaccgccgctgtcagacacgatcaattcagatactacggttacgcctccgttattaacttattggatttcacctctgttgtcgtcccagtcactttcgctgataagaatattgataagaagaacgaatcttttaaagctgtttccgaattggatgctttggttcaagaagaatacgacccagaggcttatcacggtgctcctgttgctgttcaagttattggtagaagattgtccgaagagagaactttggctatcgccgaagaagtcggtaaattgttgggtaacgtcgtcactccataaggagattgataagacttttctagttgcatatcttttatatttaaatcttatctattagttaattttttgtaatttatccttatatatagtctggttattctaaaatatcatttcagtatctaaaaattcccctcttttttcagttatatcttaacaggcgataacttcgtataatgtatgctatacgaagttatgcggccgccagcacgcagcacgctgtatttacgtatttaattttatatatttgtgcatacactactagggaagacttgaaaaaaacctaggaaatgaaaaaacgacacaggaagtcccgtatttactattttttccttccttttgatggggcagggcggaaatagaggataggataagcctactgc

SEQ ID NO: 98 - DNA, 8719 bp, Artificial Sequence
  Sequence put together from multiple organisms: Saccharomyces cerevisiae and P1 bacteriophage
atcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagagaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaatctagaatgagtgaatctccaatgttcgctgccaacggcatgccaaaggtaaatcaaggtgctgaagaagatgtcagaattttaggttacgacccattagcttctccagctctccttcaagtgcaaatcccagccacaccaacttctttggaaactgccaagagaggtagaagagaagctatagatattattaccggtaaagacgacagagttcttgtcattgtcggtccttgttccatccatgatcttgaagccgctcaagaatacgctttgagattaaagaaattgtcagatgaattaaaaggtgatttatccatcattatgagagcatacttggagaagccaagaacaaccgtcggctggaaaggtctaattaatgaccctgatgttaacaacactttcaacatcaacaagggtttgcaatccgctagacaattgtttgtcaacttgacaaatatcggtttgccaattggttctgaaatgcttgataccatttctcctaaatacttggctgatttggtctccttcggtgccattggtgccagaaccaccgaatctcaactgcacagagaattggcctccggtttgtctttcccagttggtttcaagaacggtaccgatggtaccttaaatgttgctgtggatgcttgtcaagccgctgctcattctcaccatttcatgggtgttactaagcatggtgttgctgctatcaccactactaagggtaacgaacactgcttcgttattctaagaggtggtaaaaagggtaccaactacgacgctaagtccgttgcagaagctaaggctcaattgcctgccggttccaacggtctaatgattgactactctcacggtaactccaataaggatttcagaaaccaaccaaaggtcaatgacgttgtttgtgagcaaatcgctaacggtgaaaacgccattaccggtgtcatgattgaatcaaacatcaacgaaggtaaccaaggcatcccagccgaaggtaaagccggcttgaaatatggtgtttccatcactgatgcttgtataggttgggaaactactgaagacgtcttgaggaaattggctgctgctgtcagacaaagaagagaagttaacaagaaatagatgtttttttaatgatatatgtaacgtacattctttcctctaccactgccaattcggtattatttaattgtgtttagcgctatttactaattaactagaaactcaatttttaaaggcaaagctcgctgacctttcactgatttcgtggatgttatactatcagttactcttctgcaaaaaaaaattgagtcatatcgtagctttgggattatttttctctctctccacggctaattaggtgatcatgaaaaaatgaaaaattcatgagaaaagagtcagacatcgaaacatacataagttgatattcctttgatatcgacgactactcaatcaggttttaaaagaaaagaggcagctattgaagtagcagtatccagtttaggttttttaattatttacaagtaaagaaaaagagaatgccggtcgttcacggcggccgcgccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaactcttttttacagatcatcaaggaagtaattatctactttttacaagaattcatgtctaatttacttactgttcaccaaaacttgcctgcattaccagttgacgcaacctccgatgaagtcagaaagaaccttatggatatgtttagagatagacaagctttctccgaacatacttggaaaatgttattatccgtttgtagatcctgggccgcttggtgtaaacttaacaatagaaaatggtttcctgctgaaccagaagacgtcagagattacttactttacttacaagctagaggtttggctgttaaaactatccaacaacacttaggtcaattgaatatgttacacagaagatccggtttaccaagaccatccgattccaacgcagtttcccttgttatgagaagaattagaaaagaaaatgttgacgctggtgaaagagctaaacaagcattagcatttgaaagaaccgatttcgatcaagttagatccttaatggaaaattccgatagatgtcaagatattagaaacttagctttcttaggtattgcttacaacacattattaagaatcgctgaaattgctagaattagagttaaagatatttcaagaaccgatggcggtagaatgttaatccacattggcagaacaaaaaccttagtctccacagcaggcgtcgaaaaagcattatcattaggtgttactaaattagttgaacgttggatttccgtttccggtgttgcagatgacccaaacaactacttattctgtcgtgttagaaaaaatggtgttgccgctccttccgctacctcacaattatccacaagagcattagaaggcatttttgaagctacccacagacttatttatggtgcaaaagacgattccggtcaaagatatttagcttggtctggtcattccgctagagttggtgccgcaagagacatggcaagagctggtgtttctattcctgaaattatgcaagccggtggttggactaatgttaacattgttatgaactatatcagaaacttagattccgaaacaggtgctatggttagattacttgaagacggtgattaagctagctaagatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgag

SEQ ID NO: 99 - DNA, 1632 bp, Saccharomyces cerevisiae
ggcaacggttcatcatctcatggatctgcacatgaacaaacaccagagtcaaacgacgttgaaattgaggctactgcgccaattgatgacaatacagacgatgataacaaaccgaagttatctgatgtagaaaaggattagagatgctaagagatagtgatgatatttcataaataatgtaattctatatatgttaattaccttttttgcgaggcatatttatggtgaaggataagttttgaccatcaaagaaggttaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaagcttcatggcctttataaaaaggaaccatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttg

SEQ ID NO: 100 - DNA, 4158 bp, Artificial Sequence
  Sequence put together from multiple organisms: Saccharomyces cerevisiae, and Bacillus cereus
tgagctccgggtgggaggaaggcgcggcaattagaatgtgtgggtgcggaagctcgccgctcccatcaagagagtggaagacgtatggtctgggtgcgaagtaccaccacgtttctttttcatctcttaagtgggattcttacgaaacacgtcacagggtcaaaagaaagagaacaaaagcaatattgtaattgtctcagtccacggcaatgacatggcatggccccgaaggctttttttgtctgtcttccttgggtcttaccccgccacgcgttaatagtgagacaagcaggaaatccgtatcattttctcgcatacacgaacccgcgtgcgcctggtaaattgcaggattctcattgtccggttttctttatgggaataatcatcatcaccattatcactgttactcttgcgatcatcatcattaacataatttttttaacgctgtttgatgatggtatgtgcttttattgttccttactcaccttttcctttgtgtcttttaattttgaccattttgaccattttgacctttgatgatgtgtgagttcctcttttctttttttcttttcttttttcctttttttttcttttcttactgtgttaatcactttctttcctttttgttcatattgtcgtcttgttcattttcgttcaattgataatgtatataaatctttcgtaagtatctcttgattgccatttttttctttccaagtttccttgttctcgaggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaagtctagaatgacaacatcaaatacctacaaattctatctaaacggtgaatggagagaatcttcctctggagaaactattgagataccatcaccatacttacatgaagtgatcggacaggttcaagcaatcactagaggagaggttgacgaagcgattgctagcgctaaggaagcacagaaatcttgggctgaggcatctctacaagatagagctaagtacttgtacaaatgggcagatgaattggtaaacatgcaagacgaaatcgccgatatcatcatgaaggaagtgggcaagggttacaaagacgctaaaaaggaggttgttagaaccgccgatttcatcagatacaccattgaagaggcactccatatgcacggtgaatccatgatgggcgattcatttcctggtggaacaaaatctaagctagcaataatccaaagagcgcctctgggtgtagtcttagccatcgctccattcaattaccctgtaaacctttctgctgcaaaattggcaccagccttaattatgggtaacgctgtgatattcaagccagcaactcagggtgctatttccggcatcaaaatggttgaagctttgcataaggctggtttgccaaagggtttggttaacgttgccacaggtagaggtagcgtcataggcgattatttggtcgaacacgaagggataaacatggtttccttcaccggtggcactaacactggtaagcatttagcaaaaaaggcctcaatgattccattagtcttggaacttggtggcaaagatccaggcatcgttcgtgaagatgcagacctacaagatgctgcgaatcatatcgtatctggtgcgttcagttactcagggcagagatgtacagccattaagagagtccttgttcatgaaaatgttgctgatgaactggtatcattggttaaggaacaagtggcaaagctttctgtgggatcaccagagcaagattcaacaattgttcctctgattgacgataagtccgctgattttgttcagggtttagtggacgatgcagtcgaaaagggcgctacaattgtcattgggaacaagagagaacgtaacctaatctacccaacattgattgatcacgtcacagaggaaatgaaagttgcctgggaggaaccattcggtcctattcttccaattattagagttagtagcgacgagcaagctattgaaattgcaaataagagtgagttcggattacaagcttctgtgtttaccaaagacataaacaaggcattcgcaatcgcaaataagattgagactggttcagtgcaaatcaacggtagaacagagagaggaccagatcactttccttttatcggggttaagggatctgggatgggtgcccaaggcatcagaaagtctttggaatctatgactagagaaaaagttactgtcttaaatctcgtatgattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacggccggccataacttcgtataatgtatgctatacgaagttatggcaacggttcatcatctcatggatctgcacatgaacaaacaccagagtcaaacgacgttgaaattgaggctactgcgccaattgatgacaatacagacgatgataacaaaccgaagttatctgatgtagaaaaggattagagatgctaagagatagtgatgatatttcataaataatgtaattctatatatgttaattaccttttttgcgaggcatatttatggtgaaggataagttttgaccatcaaagaaggttaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacgcggccgcggc

SEQ ID NO: 101 - DNA, 1127 bp, Saccharomyces  cerevisiae
gctccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaagcttcatggcctttataaaaaggaaccatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttgataacttcgtataatgtatgctatacgaagttatctcgaggataaaactactacgctaaaaataaaataaaaatgtatgatttccctccatttccgaccaattgtataattttatatctgcatgacttaataatataatataatacttataaaatacgaatagaaaaatttaaaccgatgtaatgcatccttttctttgttgtc

SEQ ID NO: 102 - DNA, 4542 bp, Artificial Sequence
  Sequence put together from multiple organisms: Saccharomyces cerevisiae, Bacillus cereus, and Aspergillus nidulans
tgagctccgggtgggaggaaggcgcggcaattagaatgtgtgggtgcggaagctcgccgctcccatcaagagagtggaagacgtatggtctgggtgcgaagtaccaccacgtttctttttcatctcttaagtgggattcttacgaaacacgtcacagggtcaaaagaaagagaacaaaagcaatattgtaattgtctcagtccacggcaatgacatggcatggccccgaaggctttttttgtctgtcttccttgggtcttaccccgccacgcgttaatagtgagacaagcaggaaatccgtatcattttctcgcatacacgaacccgcgtgcgcctggtaaattgcaggattctcattgtccggttttctttatgggaataatcatcatcaccattatcactgttactcttgcgatcatcatcattaacataatttttttaacgctgtttgatgatggtatgtgcttttattgttccttactcaccttttcctttgtgtcttttaattttgaccattttgaccattttgacctttgatgatgtgtgagttcctcttttctttttttcttttcttttttcctttttttttcttttcttactgtgttaatcactttctttcctttttgttcatattgtcgtcttgttcattttcgttcaattgataatgtatataaatctttcgtaagtatctcttgattgccatttttttctttccaagtttccttgttctcgaggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaagtctagaatgacaacatcaaatacctacaaattctatctaaacggtgaatggagagaatcttcctctggagaaactattgagataccatcaccatacttacatgaagtgatcggacaggttcaagcaatcactagaggagaggttgacgaagcgattgctagcgctaaggaagcacagaaatcttgggctgaggcatctctacaagatagagctaagtacttgtacaaatgggcagatgaattggtaaacatgcaagacgaaatcgccgatatcatcatgaaggaagtgggcaagggttacaaagacgctaaaaaggaggttgttagaaccgccgatttcatcagatacaccattgaagaggcactccatatgcacggtgaatccatgatgggcgattcatttcctggtggaacaaaatctaagctagcaataatccaaagagcgcctctgggtgtagtcttagccatcgctccattcaattaccctgtaaacctttctgctgcaaaattggcaccagccttaattatgggtaacgctgtgatattcaagccagcaactcagggtgctatttccggcatcaaaatggttgaagctttgcataaggctggtttgccaaagggtttggttaacgttgccacaggtagaggtagcgtcataggcgattatttggtcgaacacgaagggataaacatggtttccttcaccggtggcactaacactggtaagcatttagcaaaaaaggcctcaatgattccattagtcttggaacttggtggcaaagatccaggcatcgttcgtgaagatgcagacctacaagatgctgcgaatcatatcgtatctggtgcgttcagttactcagggcagagatgtacagccattaagagagtccttgttcatgaaaatgttgctgatgaactggtatcattggttaaggaacaagtggcaaagctttctgtgggatcaccagagcaagattcaacaattgttcctctgattgacgataagtccgctgattttgttcagggtttagtggacgatgcagtcgaaaagggcgctacaattgtcattgggaacaagagagaacgtaacctaatctacccaacattgattgatcacgtcacagaggaaatgaaagttgcctgggaggaaccattcggtcctattcttccaattattagagttagtagcgacgagcaagctattgaaattgcaaataagagtgagttcggattacaagcttctgtgtttaccaaagacataaacaaggcattcgcaatcgcaaataagattgagactggttcagtgcaaatcaacggtagaacagagagaggaccagatcactttccttttatcggggttaagggatctgggatgggtgcccaaggcatcagaaagtctttggaatctatgactagagaaaaagttactgtcttaaatctcgtatgattaaacaggccccttttcctttgtcgatatcatgtaattagttatgtcacgcttacattcacgccctcctcccacatccgctctaaccgaaaaggaaggagttagacaacctgaagtctaggtccctatttatttttttatagttatgttagtattaagaacgttatttatatttcaaatttttcttttttttctgtacaaacgcgtgtacgcatgtaacgggcagacggccggccataacttcgtataatgtatgctatacgaagttatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtggcgttaattacccgtactaaaggtttggaaaagaaaaaagagaccgcctcgtttctttttcttcgtcgaaaaaggcaataaaaatttttatcacgtttctttttcttgaaaaattttttttttgatttttttctctttcgatgacctcccattgatatttaagttaataaatggtcttcaatttctcaagtttcagtttcgtttttcttgttctattacaactttttttacttcttgctcattagaaagaaagcatagcaatctaatctaagttttaattacaaaatgccacaatcctgggaagaattggccgccgacaaacgtgcccgtttggctaaaaccattcctgacgaatggaaggttcaaactttgcctgccgaagattccgttattgatttcccaaagaagtccggtattttgtctgaggctgaattgaagattaccgaagcctctgctgctgatttggtctccaagttggccgctggtgagttgacttctgttgaagtcactttggctttttgtaagagagctgctattgctcaacaattaaccaactgtgctcacgaattcttcccagatgctgctttagctcaagctagagaattagatgaatactacgctaagcataagagaccagttggtccattacacggtttaccaatctctttaaaggaccaattgcgtgttaagggttacgaaacctccatgggttacatttcctggttaaacaaatacgatgaaggtgattccgtcttaaccaccatgttgagaaaagctggtgctgttttctacgttaagacctctgtcccacaaaccttgatggtctgtgaaaccgtcaacaacatcattggtagaactgtcaatccaagaaacaaaaattggtcctgtggtggttcttctggtggtgaaggtgctattgttggtattagaggtggtgttattggtgtcggtactgacattggtggttccattagagtcccagctgctttcaactttttatacggtttgagaccatctcacggtagattgccatatgctaaaatggctaactctatggaaggtcaagaaaccgttcactccgtcgttggtcctatcactcactccgtcgaagacttgagattgttcaccaaatctgtcttgggtcaagaaccttggaagtacgactctaaggtcatccccatgccatggagacaatctgaatctgacatcattgcctctaagattaagaatggtggtttgaacattggttattacaatttcgacggtaacgtcttgccacacccaccaattttacgtggtgtcgaaactaccgttgccgctttggcggccgcggca

SEQ ID NO: 103 - DNA, 1363 bp, Artificial Sequence
  Sequence put together from multiple organisms: Saccharomyces cerevisiae, and Aspergillus nidulans
agaggtggtgttattggtgtcggtactgacattggtggttccattagagtcccagctgctttcaactttttatacggtttgagaccatctcacggtagattgccatatgctaaaatggctaactctatggaaggtcaagaaaccgttcactccgtcgttggtcctatcactcactccgtcgaagacttgagattgttcaccaaatctgtcttgggtcaagaaccttggaagtacgactctaaggtcatccccatgccatggagacaatctgaatctgacatcattgcctctaagattaagaatggtggtttgaacattggttattacaatttcgacggtaacgtcttgccacacccaccaattttacgtggtgtcgaaactaccgttgccgctttggccaaggctggtcacaccgttactccatggactccatacaagcatgatttctgtcatgacttgatttcccacatctatgctgctgatggttctgccgacgtcatgagagacatttctgcctctggtgagccagccatccctaacattaaggacttgttgaacccaaatattaaggctgttaacatgaacgaattgtgggacactcatttacaaaagtggaactatcaaatggaatacttggaaaagtggcgtgaagctgaagaaaaagctggtaaggaattggacgctattatcgctccaattactcctaccgtcgctgtcagacacgatcaattcagatactacggttacgcctccgttattagcttattggatttcacctctgttgtcgtcccagtcactttcgctgataagaatattgataagaagaacgaatcttttaaagctgtttccgaattggatgctttggttcaagaagaatacgacccagaggcttatcacggtgctcctgttgctgttcaagttattggtagaagattgtccgaagagagaactttggctatcgccgaagaagtcggtaaattgttgggtaacgtcgtcactccataaggagattgataagacttttctagttgcatatcttttatatttaaatcttatctattagttaattttttgtaatttatccttatatatagtctggttattctaaaatatcatttcagtatctaaaaattcccctcttttttcagttatatcttaacaggcgataacttcgtataatgtatgctatacgaagttatgataaaactactacgctaaaaataaaataaaaatgtatgatttccctccatttccgaccaattgtataattttatatctgcatgacttaataatataatataatacttataaaatacgaatagaaaaatttaaaccgatgtaatgcatccttttctttgttgtc

SEQ ID NO: 104 - DNA, 5087 bp, Artificial Sequence
  Sequence put together from multiple organisms: Saccharomyces cerevisiae, and Magnaporthe grisea
ggccgctccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaagcttcatggcctttataaaaaggaaccatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttgataacttcgtataatgtatgctatacgaagttatctcgagtaacacttacagagtcctatcaggaaagaataaaagccgatcaagcttcattctcaggtaacaactggagcactggcgagctttgctctactatataagataaaatatgcactaaaagtttgcatttctttacataactaaaactaagacattatgcatagcttacctgatcaaaaagtatgtaaacttgttaacatcttcacatgtgattcatctggtcgtactttcttgcggtgcagtgtaatatttctacccacgtgactataattgagcttgaaaactgtggcgtttttccaccgatgggtccacgccagatattaaccgaagccaaaataccgatgaaatttctgagatagctcttgtaaacgacgtcaaatcttcatatgcaaggagatcttgatttctttttggtagtcatctgtcgtcttgaggcgtataagaaggaggttatatctgtcctttctacaaagtattttcgagaatcttgcctctgccccttttttctttttttaaaaggtttaaaaaacataactgtcttcaatatatccagtatttacgacaatatacaaacataatctctagaatgaaattcatctccaccttccttacattcatcctagcagccgtgagcgttacagccgtatacattaacggttctataatcacaccatgtgattctttaatttactgtagaggggaattgttaaaggaagtcgaattagcacatccatttgccgatagtaagacattcgttgatatgccaactatcaaacctgtcgatgaagtgattgaagccttcaataagttacaaaagccactgtctaacaacacagagctacaagattttctaagagagaacttcgcacaagccggcggagagttggaagaggttccaaattctgaattagaaaccgatccagttttcttagacaaattggatgacaccgttatcagagaatttgttgaaaaagttattgatatatggccttcactgacacgtagatacaagggtccatctaattgtgaggcttgcgctgactcctttattccagttaatagaaccttcgtagttgctgggggcagatttagagaaccatattattgggacagttactggattcttgagggtttgctgagaactggtggcgctttcactaacatttctaaaaacaccgttgaaaacttcttagatttggtcgaaacaattggcttcgtaccaaacggtgcacgtatttactacaaaaatagatcacaacctccattgttgtctcaaatggtgcgtatttacgtggaacatacaaatgacaccagtatcctcggtagagctgtgcctttgttgatcaaggaacatgaatttttcattaacaaccgttcaatcgatgttgaggcctccaacggtaaaacatacagattacagagatacgctgtaaccaatactcaaccaagacctgagtcttatagagaagattacataacagccagtaacagatcctactactcaccatctggtatcatctaccctgaatcccaccaactaaacgaatctgaaaaggctgttctgtatagccatttagcatcaggggcagaatctggatgggactatacctcaagatggctctctacaccttctgatgccgtgagagataactactttccattgagatcactaaatacaaacaatatagttccagtagaccttaactcaattttgtacgcaaacgaagtggccatcgctgagttccttaacagaactggaaacagtacaggtgcatcagattggatggatctagcaaagcaaagatcagaggctatgtacgcccttatgtggaatgaaactctctggtcatactttgattacaacatgacatctaagactcaaaacagattcataccagtcgatgaagatgcagtttcaattgagacaaataacgctccagcaggacaacaagtctttttccatgtcgcacaatactaccctttctggactggcgcagccccaagatccttgaaaaataatccattggctgttttgagagcatacgagcgtatcgatgcttacttggacatcaagcgtggagcaattccagcgacaaacttaaagactggtcagcaatgggacgagccaaacgtctggcctccattaatgcacattctgatggaagggctgaccagagtaccagcgacatttggggaagatgatgtcgcatggacagaaatacaagacttagctctaagacttggtcagagatacttagattctactttttgcacttggtacgctactggtggttcaacatctgaaacaccacagctacagggattgaacgctgaagataagggtatcatgttcgaaaagtacggtgacaattctacaaacgttgctggttccggcggggagtacgaagtggttgagggtttcggttggacaaatggtgttttgatgtgggtcgcagatactttcaataacaagctcactagacctgattgcggtaacattaccgctgcaaatgttcactccgacggttctcaagccagaaagagaggtgagatgtggtcagctttagaaatgcatccttacgatgcagcttggactaaagagttcggtgcgagaaaggttagaagagacaaggccgaagcgagagcacttggaaatgttatgggcggcgtctgattaattaatttaccagcttactatccttcttgaaaatatgcactctatatcttttagttcttaattgcaacacatagatttgctgtataacgaattttatgctatttttttaatttggagttcggtgatgaaagtgtcacagcgaatttcctcacatgtagggaccgaattgtttacaagttctctgtaccaccatggagacatcaaagattgaaaatctatggaaagatatggacggtagcaacaagaatatagcacgagccgcggagttcatttcgttacttttgatatcgctcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcaggccggcagcacgcagcacgctgtatttacgtatttaattttatatatttgtgcatacactactagggaagacttgaaaaaaacctaggaaatgaaaaaacgacacaggaagtcccgtatttactattttttccttccttttgatggggcagggcggaaatagaggataggataagcctactgcttagctgtttccgtctctacttcggtagttgtctcaattgtcgtttcagtattacctttagagccgctagacgatggttgagctatttgttgagggaaaactaagttcatgtaacacacgcataacccgattaaactcatgaatagcttgattgcaggaggctggtccattggagatggtgccttattttccttataggcaacgatgatgtcttcgtcggtgttcaggtagtagtgtacactctgaatcagggagaaccaggcaatgaacttgttcctcaagaaaatagcggccataggcatggattggttaaccacaccagatatgcttggtgtggcagaatatagtccttttggtggcgcaattttcttgtacctgtggtagaaagggagcggttgaactgttagtatatattggcaatatcagcaaatttgaaagaaaattgtcggtgaaaaacatacgaaacacaaaggtcgggccttgcaacgttattcaaagtcattgtttagttgaggaggtagcagcggagtatatgtattccttttttttgcctatggatgttgtaccatgcccattctgctcaagcttttgttaaaattatttttcagtattttttcttccatgttgcgcgttacgagaacagaagcgacagataaccgcaatcatacaactagcgctactgcggggtgtaaaaagcacaagaactaagccaagatcacaacagttatcgataaaatagcagtgtttgcatggccattgagaaggacaacattggcgtgcggcatg

SEQ ID NO: 105 - DNA, 5236 bp, Artificial Sequence
  Sequence put together from multiple organisms: Saccharomyces cerevisiae, Magnaporthe grisea, and Aspergillus nidulans
ggccgcgaaggtgctattgttggtattagaggtggtgttattggtgtcggtactgacattggtggttccattagagtcccagctgctttcaactttttatacggtttgagaccatctcacggtagattgccatatgctaaaatggctaactctatggaaggtcaagaaaccgttcactccgtcgttggtcctatcactcactccgtcgaagacttgagattgttcaccaaatctgtcttgggtcaagaaccttggaagtacgactctaaggtcatcccaatgccatggagacaatctgaatctgacatcattgcctctaagattaagaatggtggtttgaacattggttattacaatttcgacggtaacgtcttgccacacccaccaattttacgtggtgtcgaaactaccgttgccgctttggccaaggctggtcacaccgttactccatggactccatacaagcatgatttcggtcatgacttgatttcccacatctatgctgctgatggttctgccgacgtcatgagagacatttctgcctctggtgagccagccatccctaacattaaggacttgttgaacccaaatattaaggctgttaacatgaacgaattgtgggacactcatttacaaaagtggaactatcaaatggaatacttggaaaagtggcgtgaagctgaagaaaaagctggtaaggaattggacgctattatcgctccaattactcctaccgccgctgtcagacacgatcaattcagatactacggttacgcctccgttattaacttattggatttcacctctgttgtcgtcccagtcactttcgctgataagaatattgataagaagaacgaatcttttaaagctgtttccgaattggatgctttggttcaagaagaatacgacccagaggcttatcacggtgctcctgttgctgttcaagttattggtagaagattgtccgaagagagaactttggctatcgccgaagaagtcggtaaattgttgggtaacgtcgtcactccataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacataacttcgtataatgtatgctatacgaagttatctcgagtaacacttacagagtcctatcaggaaagaataaaagccgatcaagcttcattctcaggtaacaactggagcactggcgagctttgctctactatataagataaaatatgcactaaaagtttgcatttctttacataactaaaactaagacattatgcatagcttacctgatcaaaaagtatgtaaacttgttaacatcttcacatgtgattcatctggtcgtactttcttgcggtgcagtgtaatatttctacccacgtgactataattgagcttgaaaactgtggcgtttttccaccgatgggtccacgccagatattaaccgaagccaaaataccgatgaaatttctgagatagctcttgtaaacgacgtcaaatcttcatatgcaaggagatcttgatttctttttggtagtcatctgtcgtcttgaggcgtataagaaggaggttatatctgtcctttctacaaagtattttcgagaatcttgcctctgccccttttttctttttttaaaaggtttaaaaaacataactgtcttcaatatatccagtatttacgacaatatacaaacataatctctagaatgaaattcatctccaccttccttacattcatcctagcagccgtgagcgttacagccgtatacattaacggttctataatcacaccatgtgattctttaatttactgtagaggggaattgttaaaggaagtcgaattagcacatccatttgccgatagtaagacattcgttgatatgccaactatcaaacctgtcgatgaagtgattgaagccttcaataagttacaaaagccactgtctaacaacacagagctacaagattttctaagagagaacttcgcacaagccggcggagagttggaagaggttccaaattctgaattagaaaccgatccagttttcttagacaaattggatgacaccgttatcagagaatttgttgaaaaagttattgatatatggccttcactgacacgtagatacaagggtccatctaattgtgaggcttgcgctgactcctttattccagttaatagaaccttcgtagttgctgggggcagatttagagaaccatattattgggacagttactggattcttgagggtttgctgagaactggtggcgctttcactaacatttctaaaaacaccgttgaaaacttcttagatttggtcgaaacaattggcttcgtaccaaacggtgcacgtatttactacaaaaatagatcacaacctccattgttgtctcaaatggtgcgtatttacgtggaacatacaaatgacaccagtatcctcggtagagctgtgcctttgttgatcaaggaacatgaatttttcattaacaaccgttcaatcgatgttgaggcctccaacggtaaaacatacagattacagagatacgctgtaaccaatactcaaccaagacctgagtcttatagagaagattacataacagccagtaacagatcctactactcaccatctggtatcatctaccctgaatcccaccaactaaacgaatctgaaaaggctgttctgtatagccatttagcatcaggggcagaatctggatgggactatacctcaagatggctctctacaccttctgatgccgtgagagataactactttccattgagatcactaaatacaaacaatatagttccagtagaccttaactcaattttgtacgcaaacgaagtggccatcgctgagttccttaacagaactggaaacagtacaggtgcatcagattggatggatctagcaaagcaaagatcagaggctatgtacgcccttatgtggaatgaaactctctggtcatactttgattacaacatgacatctaagactcaaaacagattcataccagtcgatgaagatgcagtttcaattgagacaaataacgctccagcaggacaacaagtctttttccatgtcgcacaatactaccctttctggactggcgcagccccaagatccttgaaaaataatccattggctgttttgagagcatacgagcgtatcgatgcttacttggacatcaagcgtggagcaattccagcgacaaacttaaagactggtcagcaatgggacgagccaaacgtctggcctccattaatgcacattctgatggaagggctgaccagagtaccagcgacatttggggaagatgatgtcgcatggacagaaatacaagacttagctctaagacttggtcagagatacttagattctactttttgcacttggtacgctactggtggttcaacatctgaaacaccacagctacagggattgaacgctgaagataagggtatcatgttcgaaaagtacggtgacaattctacaaacgttgctggttccggcggggagtacgaagtggttgagggtttcggttggacaaatggtgttttgatgtgggtcgcagatactttcaataacaagctcactagacctgattgcggtaacattaccgctgcaaatgttcactccgacggttctcaagccagaaagagaggtgagatgtggtcagctttagaaatgcatccttacgatgcagcttggactaaagagttcggtgcgagaaaggttagaagagacaaggccgaagcgagagcacttggaaatgttatgggcggcgtctgattaattaatttaccagcttactatccttcttgaaaatatgcactctatatcttttagttcttaattgcaacacatagatttgctgtataacgaattttatgctatttttttaatttggagttcggtgatgaaagtgtcacagcgaatttcctcacatgtagggaccgaattgtttacaagttctctgtaccaccatggagacatcaaagattgaaaatctatggaaagatatggacggtagcaacaagaatatagcacgagccgcggagttcatttcgttacttttgatatcgctcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcaggccggcagcacgcagcacgctgtatttacgtatttaattttatatatttgtgcatacactactagggaagacttgaaaaaaacctaggaaatgaaaaaacgacacaggaagtcccgtatttactattttttccttccttttgatggggcagggcggaaatagaggataggataagcctactgcttagctgtttccgtctctacttcggtagttgtctcaattgtcgtttcagtattacctttagagccgctagacgatggttgagctatttgttgagggaaaactaagttcatgtaacacacgcataacccgattaaactcatgaatagcttgattgcaggaggctggtccattggagatggtgccttattttccttataggcaacgatgatgtcttcgtcggtgttcaggtagtagtgtacactctgaatcagggagaaccaggcaatgaacttgttcctcaagaaaatagcggccataggcatggattggttaaccacaccagatatgcttggtgtggcagaatatagtccttttggtggcgcaattttcttgtacctgtggtagaaagggagcggttgaactgttagtatatattggcaatatcagcaaatttgaaagaaaattgtcggtgaaaaacatacgaaacacaaaggtcgggccttgcaacgttattcaaagtcattgtttagttgaggaggtagcagcgg

SEQ ID NO: 106 - DNA, 6386 bp, Artificial Sequence
  Sequence put together from multiple organisms: Saccharomyces cerevisiae, and Candida glabrata
ggccgctccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaagcttcatggcctttataaaaaggaaccatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttgataacttcgtataatgtatgctatacgaagttatctcgagtaacacttacagagtcctatcaggaaagaataaaagccgatcaagcttcattctcaggtaacaactggagcactggcgagctttgctctactatataagataaaatatgcactaaaagtttgcatttctttacataactaaaactaagacattatgcatagcttacctgatcaaaaagtatgtaaacttgttaacatcttcacatgtgattcatctggtcgtactttcttgcggtgcagtgtaatatttctacccacgtgactataattgagcttgaaaactgtggcgtttttccaccgatgggtccacgccagatattaaccgaagccaaaataccgatgaaatttctgagatagctcttgtaaacgacgtcaaatcttcatatgcaaggagatcttgatttctttttggtagtcatctgtcgtcttgaggcgtataagaaggaggttatatctgtcctttctacaaagtattttcgagaatcttgcctctgccccttttttctttttttaaaaggtttaaaaaacataactgtcttcaatatatccagtatttacgacaatatacaaacataatctctagaatgaaattcatctctactttccttacttttattttagctgccgtatctgtaaccgcctctaccaactcttacttctcttcctccttagcttctgcttcaccattattcaacaaagagggcagagtggttagaccaatgcgtgaaagtaacttaggcctacacgcagatcctcaaactagaaaatccagtaagacactttacgatttgttgtcagactttgacaatgcattttacgatgatgaaaacatgatcttaggatccctagccttcggtgagaatacctactccagacagccatacgtcgcaaacgggtacataggtagccgtataccaaacatcggtttcggatacgcacttgatacacttaacttgtacgctgatgcaccaggcgcacttaacaacggttggcctttgagaaacagaagattcgctggaagtttcgtttctgatttctactcactgcaagccaagttgaacagtaccaattttcctgagttagatgaaaagggttatacaactgtcatttcatcaatcccagaatggacagatttgcaattcactgtagaccttaacggcactaactggttcaatccacaatcagttctaatcgatgatgttattaattacaatcagaacttgagcatgaaggatggaattgttagcacaaacatggattggttgaacggaatgataaacattaagtctgaagtctgggcacacagaaagatccattccttgggtatcacacgtctggaaatctcattgaaccttgatgctttacctgacgagttcactgaactaccagttacaatttacgatatcatagatttcaacacttctcatagaacaacactatatgagaaaggtcaagatgaagataacaaagcgatttacatgattgtaaacccagaaaacgtaccatactcaaacgcagttgtgtactctacttgtacaatcaagggcactgaaaacaacttttctccttacaacttcacatcagatgatagaattgcgagaaactacatgacaaacctaacagaagagaacccaaaagtcgttatttacaagtacacatcagtggtttcctcagaatataataatgacgagccaaatcctaacgttaacttgaagttcgcctcaaacatcgctaacaccgcaaaaggaaactataagtctttattgtccaatcacaaaagagcttggtacgatttgtacaatgatgcctttatcgaaattccatctgatagtttattggaaatgaccgcaagatctagtctcttccatttgcttgcgaacacacgtcaatacaacgtttctacaactagaggattaccagtcggcgttggtggtctttcttcagactcttacggggggatggtcttttgggacgcagacgtatggatggctccagctctcctacctttctttccaaacatagcaatgaacatgaataactacagaaacgctactcatcaacaagccattgaaaatgctaagcaatacaattacccaggcgccgtttacccttggacatctggtagatatgcgaattgtacctctaccggtccttgcatcgactacgaataccatattaatgtagatatcgctttggcaagtttctctatttacatgaacggtgccgagggtgccgacgaagattaccttagattcacaacatggccaatggtcaaggatgctgcagtgttcttcaaggcctacgtcaaatacaatgaaacacttggagagtacgaaacttataatttaactgacccagatgaatttgctaatcatgtgaataatggagctttcacaaatgcaggaatcaaaactttgttgaaatgggcaacagacattggtactcaccttggggaggaagttgatcctaagtggatggaaattgctgataacatacatattcctagaagtgactctaacattactttggagtactctggcatgaatagctccgttgagattaagcaggctgacgttacattgatggtataccctttaggttacatcaacgatgaatctatactaaacaacgcaatcaaggatttgtattactactctgaacgtcagtctgcctctgggccagctatgacttacccagtgttcgtcgcagctgccgcttccctcttgaaccacggttcatcatcacagagttacctttacaaatctgttcttccatatctgagatcaccatttgctcaatttagcgaacaatcagatgacaatttcttaactaacggtttgacacaaccagcattcccatttttgaccgctaatggtggtttcttgcaatctatattatttggattaaccggattgagatacagttacgaagttactcctagaaccaaaaagatttcaagactactcaagtttgatccagtcaagttgccactgctacctggcggaattgcaattagaaatttcaaatacatgggacaagtactggatatcataatagacgataacaatggtacaatagctcataagggtggggataagccaattagaatcaaggttccaaatagagatattctccacgacagaaatatcacttccgcactatactcaaagagagatgacgatttatcagcgacagatgactactacggtacatacttcacactatacccaaatgaggaactggtgattcctctttacgatactaagttaaacatcgacggtaacatagccgaatctaaacaaataactaatttgactgccggagttccaggtgacgttggtttctccgcattagatgggaacaattacacacactggcagccattcgataaatcagataatgctaagttgctaattgacttaggttttaacagcactcatgtcattaaaaagggtattattttgtggggtcaaagaccagcgaaaaacatttctttgtcagttttgccacattcagagagaattgagcaactatttgcgaacatcacagatcttttagaaacatcatctataactaagggcggctctttgttaaaccagatgttaggccaaacacaatcaaacgtgaccgcagaaattgatgatgatatcctcgctttactgaactggaaaggtgacgatctggaccaactcatcccttatttgcctgatatgcatctcctacaagagaaattcattcctattttgaaggattaccctattaagccaaatcagagatactataaggaaatcattgacgatgacataatcaagttattaccatcaaacacaactgaatttacaatcgattacaattctatccctggcggggaaaagcgtgcaagatacgttgttctgacagttcacggcacctatgatgacgatgatgatcttaaaggtgcaacaatcaaggaaattgttctgcaggaatgattaattaatttaccagcttactatccttcttgaaaatatgcactctatatcttttagttcttaattgcaacacatagatttgctgtataacgaattttatgctatttttttaatttggagttcggtgatgaaagtgtcacagcgaatttcctcacatgtagggaccgaattgtttacaagttctctgtaccaccatggagacatcaaagattgaaaatctatggaaagatatggacggtagcaacaagaatatagcacgagccgcggagttcatttcgttacttttgatatcgctcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcaggccggcagcacgcagcacgctgtatttacgtatttaattttatatatttgtgcatacactactagggaagacttgaaaaaaacctaggaaatgaaaaaacgacacaggaagtcccgtatttactattttttccttccttttgatggggcagggcggaaatagaggataggataagcctactgcttagctgtttccgtctctacttcggtagttgtctcaattgtcgtttcagtattacctttagagccgctagacgatggttgagctatttgttgagggaaaactaagttcatgtaacacacgcataacccgattaaactcatgaatagcttgattgcaggaggctggtccattggagatggtgccttattttccttataggcaacgatgatgtcttcgtcggtgttcaggtagtagtgtacactctgaatcagggagaaccaggcaatgaacttgttcctcaagaaaatagcggccataggcatggattggttaaccacaccagatatgcttggtgtggcagaatatagtccttttggtggcgcaattttcttgtacctgtggtagaaagggagcggttgaactgttagtatatattggcaatatcagcaaatttgaaagaaaattgtcggtgaaaaacatacgaaacacaaaggtcgggccttgcaacgttattcaaagtcattgtttagttgaggaggtagcagcggagtatatgtattccttttttttgcctatggatgttgtaccatgcccattctgctcaagcttttgttaaaattatttttcagtattttttcttccatgttgcgcgttacgagaacagaagcgacagataaccgcaatcatacaactagcgctactgcggggtgtaaaaagcacaagaactaagccaagatcacaacagttatcgataaaatagcagtgtttgcatggccattgagaaggacaacattggcgtgcggcatg

SEQ ID NO: 107 - DNA, 6535 bp, Artificial Sequence
  Sequence put together from multiple organisms: Saccharomyces cerevisiae, Candida glabrata, and Aspergillus nidulans
ggccgcgaaggtgctattgttggtattagaggtggtgttattggtgtcggtactgacattggtggttccattagagtcccagctgctttcaactttttatacggtttgagaccatctcacggtagattgccatatgctaaaatggctaactctatggaaggtcaagaaaccgttcactccgtcgttggtcctatcactcactccgtcgaagacttgagattgttcaccaaatctgtcttgggtcaagaaccttggaagtacgactctaaggtcatcccaatgccatggagacaatctgaatctgacatcattgcctctaagattaagaatggtggtttgaacattggttattacaatttcgacggtaacgtcttgccacacccaccaattttacgtggtgtcgaaactaccgttgccgctttggccaaggctggtcacaccgttactccatggactccatacaagcatgatttcggtcatgacttgatttcccacatctatgctgctgatggttctgccgacgtcatgagagacatttctgcctctggtgagccagccatccctaacattaaggacttgttgaacccaaatattaaggctgttaacatgaacgaattgtgggacactcatttacaaaagtggaactatcaaatggaatacttggaaaagtggcgtgaagctgaagaaaaagctggtaaggaattggacgctattatcgctccaattactcctaccgccgctgtcagacacgatcaattcagatactacggttacgcctccgttattaacttattggatttcacctctgttgtcgtcccagtcactttcgctgataagaatattgataagaagaacgaatcttttaaagctgtttccgaattggatgctttggttcaagaagaatacgacccagaggcttatcacggtgctcctgttgctgttcaagttattggtagaagattgtccgaagagagaactttggctatcgccgaagaagtcggtaaattgttgggtaacgtcgtcactccataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacataacttcgtataatgtatgctatacgaagttatctcgagtaacacttacagagtcctatcaggaaagaataaaagccgatcaagcttcattctcaggtaacaactggagcactggcgagctttgctctactatataagataaaatatgcactaaaagtttgcatttctttacataactaaaactaagacattatgcatagcttacctgatcaaaaagtatgtaaacttgttaacatcttcacatgtgattcatctggtcgtactttcttgcggtgcagtgtaatatttctacccacgtgactataattgagcttgaaaactgtggcgtttttccaccgatgggtccacgccagatattaaccgaagccaaaataccgatgaaatttctgagatagctcttgtaaacgacgtcaaatcttcatatgcaaggagatcttgatttctttttggtagtcatctgtcgtcttgaggcgtataagaaggaggttatatctgtcctttctacaaagtattttcgagaatcttgcctctgccccttttttctttttttaaaaggtttaaaaaacataactgtcttcaatatatccagtatttacgacaatatacaaacataatctctagaatgaaattcatctctactttccttacttttattttagctgccgtatctgtaaccgcctctaccaactcttacttctcttcctccttagcttctgcttcaccattattcaacaaagagggcagagtggttagaccaatgcgtgaaagtaacttaggcctacacgcagatcctcaaactagaaaatccagtaagacactttacgatttgttgtcagactttgacaatgcattttacgatgatgaaaacatgatcttaggatccctagccttcggtgagaatacctactccagacagccatacgtcgcaaacgggtacataggtagccgtataccaaacatcggtttcggatacgcacttgatacacttaacttgtacgctgatgcaccaggcgcacttaacaacggttggcctttgagaaacagaagattcgctggaagtttcgtttctgatttctactcactgcaagccaagttgaacagtaccaattttcctgagttagatgaaaagggttatacaactgtcatttcatcaatcccagaatggacagatttgcaattcactgtagaccttaacggcactaactggttcaatccacaatcagttctaatcgatgatgttattaattacaatcagaacttgagcatgaaggatggaattgttagcacaaacatggattggttgaacggaatgataaacattaagtctgaagtctgggcacacagaaagatccattccttgggtatcacacgtctggaaatctcattgaaccttgatgctttacctgacgagttcactgaactaccagttacaatttacgatatcatagatttcaacacttctcatagaacaacactatatgagaaaggtcaagatgaagataacaaagcgatttacatgattgtaaacccagaaaacgtaccatactcaaacgcagttgtgtactctacttgtacaatcaagggcactgaaaacaacttttctccttacaacttcacatcagatgatagaattgcgagaaactacatgacaaacctaacagaagagaacccaaaagtcgttatttacaagtacacatcagtggtttcctcagaatataataatgacgagccaaatcctaacgttaacttgaagttcgcctcaaacatcgctaacaccgcaaaaggaaactataagtctttattgtccaatcacaaaagagcttggtacgatttgtacaatgatgcctttatcgaaattccatctgatagtttattggaaatgaccgcaagatctagtctcttccatttgcttgcgaacacacgtcaatacaacgtttctacaactagaggattaccagtcggcgttggtggtctttcttcagactcttacggggggatggtcttttgggacgcagacgtatggatggctccagctctcctacctttctttccaaacatagcaatgaacatgaataactacagaaacgctactcatcaacaagccattgaaaatgctaagcaatacaattacccaggcgccgtttacccttggacatctggtagatatgcgaattgtacctctaccggtccttgcatcgactacgaataccatattaatgtagatatcgctttggcaagtttctctatttacatgaacggtgccgagggtgccgacgaagattaccttagattcacaacatggccaatggtcaaggatgctgcagtgttcttcaaggcctacgtcaaatacaatgaaacacttggagagtacgaaacttataatttaactgacccagatgaatttgctaatcatgtgaataatggagctttcacaaatgcaggaatcaaaactttgttgaaatgggcaacagacattggtactcaccttggggaggaagttgatcctaagtggatggaaattgctgataacatacatattcctagaagtgactctaacattactttggagtactctggcatgaatagctccgttgagattaagcaggctgacgttacattgatggtataccctttaggttacatcaacgatgaatctatactaaacaacgcaatcaaggatttgtattactactctgaacgtcagtctgcctctgggccagctatgacttacccagtgttcgtcgcagctgccgcttccctcttgaaccacggttcatcatcacagagttacctttacaaatctgttcttccatatctgagatcaccatttgctcaatttagcgaacaatcagatgacaatttcttaactaacggtttgacacaaccagcattcccatttttgaccgctaatggtggtttcttgcaatctatattatttggattaaccggattgagatacagttacgaagttactcctagaaccaaaaagatttcaagactactcaagtttgatccagtcaagttgccactgctacctggcggaattgcaattagaaatttcaaatacatgggacaagtactggatatcataatagacgataacaatggtacaatagctcataagggtggggataagccaattagaatcaaggttccaaatagagatattctccacgacagaaatatcacttccgcactatactcaaagagagatgacgatttatcagcgacagatgactactacggtacatacttcacactatacccaaatgaggaactggtgattcctctttacgatactaagttaaacatcgacggtaacatagccgaatctaaacaaataactaatttgactgccggagttccaggtgacgttggtttctccgcattagatgggaacaattacacacactggcagccattcgataaatcagataatgctaagttgctaattgacttaggttttaacagcactcatgtcattaaaaagggtattattttgtggggtcaaagaccagcgaaaaacatttctttgtcagttttgccacattcagagagaattgagcaactatttgcgaacatcacagatcttttagaaacatcatctataactaagggcggctctttgttaaaccagatgttaggccaaacacaatcaaacgtgaccgcagaaattgatgatgatatcctcgctttactgaactggaaaggtgacgatctggaccaactcatcccttatttgcctgatatgcatctcctacaagagaaattcattcctattttgaaggattaccctattaagccaaatcagagatactataaggaaatcattgacgatgacataatcaagttattaccatcaaacacaactgaatttacaatcgattacaattctatccctggcggggaaaagcgtgcaagatacgttgttctgacagttcacggcacctatgatgacgatgatgatcttaaaggtgcaacaatcaaggaaattgttctgcaggaatgattaattaatttaccagcttactatccttcttgaaaatatgcactctatatcttttagttcttaattgcaacacatagatttgctgtataacgaattttatgctatttttttaatttggagttcggtgatgaaagtgtcacagcgaatttcctcacatgtagggaccgaattgtttacaagttctctgtaccaccatggagacatcaaagattgaaaatctatggaaagatatggacggtagcaacaagaatatagcacgagccgcggagttcatttcgttacttttgatatcgctcacaactattgcgaagcgcttcagtgaaaaaatcataaggaaaagttgtaaatattattggtagtattcgtttggtaaagtagagggggtaatttttcccctttattttgttcatacattcttaaattgctttgcctctccttttggaaagctatacttcggagcactgttgagcgaaggctcaggccggcagcacgcagcacgctgtatttacgtatttaattttatatatttgtgcatacactactagggaagacttgaaaaaaacctaggaaatgaaaaaacgacacaggaagtcccgtatttactattttttccttccttttgatggggcagggcggaaatagaggataggataagcctactgcttagctgtttccgtctctacttcggtagttgtctcaattgtcgtttcagtattacctttagagccgctagacgatggttgagctatttgttgagggaaaactaagttcatgtaacacacgcataacccgattaaactcatgaatagcttgattgcaggaggctggtccattggagatggtgccttattttccttataggcaacgatgatgtcttcgtcggtgttcaggtagtagtgtacactctgaatcagggagaaccaggcaatgaacttgttcctcaagaaaatagcggccataggcatggattggttaaccacaccagatatgcttggtgtggcagaatatagtccttttggtggcgcaattttcttgtacctgtggtagaaagggagcggttgaactgttagtatatattggcaatatcagcaaatttgaaagaaaattgtcggtgaaaaacatacgaaacacaaaggtcgggccttgcaacgttattcaaagtcattgtttagttgaggaggtagcagcgg

SEQ ID NO: 108 - protein, 605 aa, Rhizopus microsporus; identical to SEQ ID NO: 95

SEQ ID NO: 109 - protein, 604 aa, Rhizopus delemar
MQLFNLPLKVSFFLVLSYFSLLVSAASIPSSASVQLDSYNYDGSTFSGKIYVKNIAYSKKVTVIYADGSDNWNNNGNTIAASYSAPISGSNYEYWTFSASINGIKEFYIKYEVSGKTYYDNNNSANYQVSTSKPTTTTATATTTTAPSTSTTTPPSSSEPATFPTGNSTISSWIKKQEGISRFAMLRNINPPGSATGFIAASLSTAGPDYYYAWTRDAALTSNVIVYEYNTTLSGNKTILNVLKDYVTFSVKTQSTSTVCNCLGEPKFNPDGSGYTGAWGRPQNDGPAERATTFILFADSYLTQTKDASYVTGTLKPAIFKDLDYVVNVWSNGCFDLWEEVNGVHFYTLMVMRKGLLLGADFAKRNGDSTRASTYSSTASTIANKISSFWVSSNNWIQVSQSVTGGVSKKGLDVSTLLAANLGSVDDGFFTPGSEKILATAVAVEDSFASLYPINKNLPSYLGNSIGRYPEDTYNGNGNSQGNPWFLAVTGYAELYYRAIKEWIGNGGVTVSSISLPFFKKFDSSATSGKKYTVGTSDFNNLAQNIALAADRFLSTVQLHAHNNGSLAEEFDRTTGLSTGARDLTWSHASLITASYAKAGAPAA

SEQ ID NO: 110 - DNA, 1440 bp, Bacillus cereus
atgacaacatcaaatacctacaaattctatctaaacggtgaatggagagaatcttcctctggagaaactattgagataccatcaccatacttacatgaagtgatcggacaggttcaagcaatcactagaggagaggttgacgaagcgattgctagcgctaaggaagcacagaaatcttgggctgaggcatctctacaagatagagctaagtacttgtacaaatgggcagatgaattggtaaacatgcaagacgaaatcgccgatatcatcatgaaggaagtgggcaagggttacaaagacgctaaaaaggaggttgttagaaccgccgatttcatcagatacaccattgaagaggcactccatatgcacggtgaatccatgatgggcgattcatttcctggtggaacaaaatctaagctagcaataatccaaagagcgcctctgggtgtagtcttagccatcgctccattcaattaccctgtaaacctttctgctgcaaaattggcaccagccttaattatgggtaacgctgtgatattcaagccagcaactcagggtgctatttccggcatcaaaatggttgaagctttgcataaggctggtttgccaaagggtttggttaacgttgccacaggtagaggtagcgtcataggcgattatttggtcgaacacgaagggataaacatggtttccttcaccggtggcactaacactggtaagcatttagcaaaaaaggcctcaatgattccattagtcttggaacttggtggcaaagatccaggcatcgttcgtgaagatgcagacctacaagatgctgcgaatcatatcgtatctggtgcgttcagttactcagggcagagatgtacagccattaagagagtccttgttcatgaaaatgttgctgatgaactggtatcattggttaaggaacaagtggcaaagctttctgtgggatcaccagagcaagattcaacaattgttcctctgattgacgataagtccgctgattttgttcagggtttagtggacgatgcagtcgaaaagggcgctacaattgtcattgggaacaagagagaacgtaacctaatctacccaacattgattgatcacgtcacagaggaaatgaaagttgcctgggaggaaccattcggtcctattcttccaattattagagttagtagcgacgagcaagctattgaaattgcaaataagagtgagttcggattacaagcttctgtgtttaccaaagacataaacaaggcattcgcaatcgcaaataagattgagactggttcagtgcaaatcaacggtagaacagagagaggaccagatcactttccttttatcggggttaagggatctgggatgggtgcccaaggcatcagaaagtctttggaatctatgactagagaaaaagttactgtcttaaatctcgtatga

SEQ ID NO: 111 - protein, 479 aa, Bacillus cereus
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLVKEQVAKLSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 112 - DNA, 577 bp, Saccharomyces cerevisiae
taacacttacagagtcctatcaggaaagaataaaagccgatcaagcttcattctcaggtaacaactggagcactggcgagctttgctctactatataagataaaatatgcactaaaagtttgcatttctttacataactaaaactaagacattatgcatagcttacctgatcaaaaagtatgtaaacttgttaacatcttcacatgtgattcatctggtcgtactttcttgcggtgcagtgtaatatttctacccacgtgactataattgagcttgaaaactgtggcgtttttccaccgatgggtccacgccagatattaaccgaagccaaaataccgatgaaatttctgagatagctcttgtaaacgacgtcaaatcttcatatgcaaggagatcttgatttctttttggtagtcatctgtcgtcttgaggcgtataagaaggaggttatatctgtcctttctacaaagtattttcgagaatcttgcctctgccccttttttctttttttaaaaggtttaaaaaacataactgtcttcaatatatccagtatttacgacaatatacaaacataatc

The invention claimed is:

1. A genetically modified yeast comprising a heterologous gene encoding a trehalase (EC 3.2.1.28) polypeptide having a sequence identity of at least 80% to at least one of the following polypeptide sequences: SEQ ID NO: 1, SEQ ID NO: 2, SEQ ID NO: 3, or SEQ ID NO: 87,
wherein the yeast is capable of producing ethanol when the yeast is present in a fermentation medium comprising trehalose and the yeast secretes the trehalase polypeptide in an amount sufficient to reduce the trehalose content of a fermentation broth to less than 2 g/L when the ethanol titer is at least 110 g/L.

2. The yeast of claim 1, wherein the trehalase polypeptide encoded by the heterologous gene comprises a sequence that has a sequence identity of at least 90%, to SEQ ID NO: 83.

3. The yeast of claim 1, wherein the trehalase polypeptide encoded by the heterologous gene comprises a sequence that has a sequence identity of to SEQ ID NO: 84 or SEQ ID NO: 85.

4. The yeast of claim 1, wherein the yeast is a genetically modified *S. cerevisiae*.

5. The yeast of claim 1, wherein the trehalase polypeptide encoded by the heterologous gene comprises a MFα2 signal sequence.

6. The yeast of claim 5, wherein the MFα2 signal sequence is SEQ ID NO: 4.

7. The yeast of claim 5, wherein the MFα2 signal sequence has a sequence identity of at least 89%, to SEQ ID NO: 4.

8. The yeast of claim 1, wherein the trehalase polypeptide encoded by the heterologous gene has a sequence identity of at least 85% to at least one of the following polypeptide sequences: SEQ ID NO: 8, SEQ ID NO: 11, SEQ ID NO: 14, or SEQ ID NO: 92.

9. The yeast of claim 1, further comprising a heterologous gene encoding a glucoamylase (EC 3.2.1.3) polypeptide.

10. The yeast of claim 1, wherein the yeast secretes trehalase in an amount sufficient to reduce the trehalose content of a fermentation broth to less than 1 g/L when the ethanol titer is at least 110 g/L.

11. The yeast of claim 1, wherein the trehalase polypeptide encoded by the heterologous gene comprises a sequence that has a sequence identity of at least 92% to SEQ ID NO: 86.

12. The yeast of claim 1, wherein the yeast is capable of producing ethanol at a titer of at least 100 g/L as measured 36 h after inoculation in a fermentation medium.

13. A process for manufacturing ethanol comprising:
fermenting a medium using a genetically modified yeast, wherein the yeast comprises a heterologous trehalase gene encoding a trehalase (EC 3.2.1.28) polypeptide having a sequence identity of at least 80% to at least one of the following polypeptide sequences: SEQ ID NO: 1, SEQ ID NO: 2, SEQ ID NO: 3, or SEQ ID NO: 87,
wherein the ethanol titer is at least 105 g/L as measured 36 h after inoculation and the trehalose content of the fermentation broth at the end of fermentation is less than 2 g/L.

14. The process of claim 13, wherein the ethanol titer is at least 120 g/L as measured 48 h after inoculation and the trehalose content of the fermentation broth at the end of fermentation is less than 1 g/L.

15. The yeast of claim 1, wherein the trehalase polypeptide comprises a sequence at least 90% identical to SEQ ID NO:1.

16. The yeast of claim 1, wherein the trehalase polypeptide comprises a sequence at least 90% identical to SEQ ID NO:2.

17. The yeast of claim 1, wherein the trehalase polypeptide comprises a sequence at least 90% identical to SEQ ID NO:3.

18. The yeast of claim 1, wherein the trehalase polypeptide comprises a sequence at least 90% identical to SEQ ID NO:87.

19. The yeast of claim 1, wherein the trehalase polypeptide comprises a sequence at least 90% identical to at least one of SEQ ID NOs: 8, 11, 14, and 92.

20. The yeast of claim 1, wherein the yeast has reduced or eliminated expression of one or more genes encoding a glycerol-3-phosphate phosphatase.

* * * * *